US012746294B2

(12) United States Patent
Liu et al.

(10) Patent No.: US 12,746,294 B2
(45) Date of Patent: Sep. 29, 2026

(54) AAV DELIVERY OF NUCLEOBASE EDITORS

(71) Applicants: The Broad Institute, Inc., Cambridge, MA (US); President and Fellows of Harvard College, Cambridge, MA (US)

(72) Inventors: David R. Liu, Cambridge, MA (US); Jonathan Ma Levy, Cambridge, MA (US); Wei Hsi Yeh, Cambridge, MA (US)

(73) Assignees: The Broad Institute, Inc., Cambridge, MA (US); President and Fellows of Harvard College, Cambridge, MA (US)

( * ) Notice: Subject to any disclaimer, the term of this patent is extended or adjusted under 35 U.S.C. 154(b) by 1259 days.

(21) Appl. No.: 17/613,025

(22) PCT Filed: May 20, 2020

(86) PCT No.: PCT/US2020/033873
§ 371 (c)(1),
(2) Date: Nov. 19, 2021

(87) PCT Pub. No.: WO2020/236982
PCT Pub. Date: Nov. 26, 2020

(65) Prior Publication Data
US 2022/0249697 A1 Aug. 11, 2022

Related U.S. Application Data

(60) Provisional application No. 62/949,275, filed on Dec. 17, 2019, provisional application No. 62/850,523, filed on May 20, 2019.

(51) Int. Cl.
*A61K 48/00* (2006.01)
*C12N 9/22* (2006.01)
*C12N 15/11* (2006.01)
*C12N 15/113* (2010.01)
*C12N 15/86* (2006.01)

(52) U.S. Cl.
CPC .............. *A61K 48/005* (2013.01); *C12N 9/22* (2013.01); *C12N 15/111* (2013.01); *C12N 15/113* (2013.01); *C12N 15/86* (2013.01); *C12N 2310/20* (2017.05)

(58) Field of Classification Search
CPC ... C07K 2319/92; C12N 15/113; C12N 15/86
See application file for complete search history.

(56) References Cited

U.S. PATENT DOCUMENTS 4,182,449 A 1/1980 Kozlow
4,186,183 A 1/1980 Steck et al.
4,217,344 A 8/1980 Vanlerberghe et al.
4,235,871 A 11/1980 Papahadjopoulos et al.
4,261,975 A 4/1981 Fullerton et al.
4,485,054 A 11/1984 Mezei et al.
4,501,728 A 2/1985 Geho et al.
4,663,290 A 5/1987 Weis et al.
4,737,323 A 4/1988 Martin et al.

(Continued)

FOREIGN PATENT DOCUMENTS

AU 2012244264 A1 11/2012
AU 2015252023 A1 11/2015

(Continued)

OTHER PUBLICATIONS

Truong, D. J., Kühner, K., Kühn, R., Werfel, S., Engelhardt, S., Wurst, W., & Ortiz, O. (2015). Development of an intein-mediated split-Cas9 system for gene therapy. Nucleic acids research, 43(13), 6450-6458. https://doi.org/10.1093/nar/gkv601 (Year: 2015).*
Truong, D. J., Kühner, K., Kühn, R., Werfel, S., Engelhardt, S., Wurst, W., & Ortiz, O. (2015). Development of an intein-mediated split-Cas9 system for gene therapy. Nucleic acids research, 43(13), 6450-6458 and pp. 1-6 of supplementary material. https://doi.org/10.1093/nar/gkv601 (Year: 2015).*
Lau, CH., Suh, Y. In vivo epigenome editing and transcriptional modulation using CRISPR technology. Transgenic Res 27, 489-509 (2018). https://doi.org/10.1007/s11248-018-0096-8 (Year: 2018).*

(Continued)

*Primary Examiner* — Celine X Qian
*Assistant Examiner* — Alexandra Rose Lippolis
(74) *Attorney, Agent, or Firm* — Wolf, Greenfield & Sacks, P.C.

(57) ABSTRACT

Provided herein are methods of delivering "split" Cas9 protein or nucleobase editors into a cell, e.g., via a recombinant adeno-associated vims (rAAV), to form a complete and functional Cas9 protein or nucleobase editor. The Cas9 protein or the nucleobase editor is split into two sections, each fused with one part of an intein system (e.g., intein-N and intein-C encoded by the dnaE-n and dnaE-c genes, respectively). Upon co-expression, the two sections of the Cas9 protein or nucleobase editor are ligated together via intein-mediated protein splicing. Nucleic acid molecules encoding the N-terminal portion of a Cas9 protein or a nucleobase editor fused to an intein, and nucleic acid molecules encoding the C-terminal portion of a Cas9 protein or nucleobase editor, are provided. Recombinant AAV vectors (e.g, vectors comprising one or more of these nucleic acid molecules each comprising an intein) and particles for the delivery of the split Cas9 protein or nucleobase editor, compositions comprising such AAV vectors and particles, and methods of using such rAAV vectors and particles are also provided. Methods of administering such compositions and AAV particles to a subject are further provided. Cells and compositions comprising these nucleic acid molecules rAAV vectors, and rAAV particles are also provided.

20 Claims, 93 Drawing Sheets

Specification includes a Sequence Listing.

(56) References Cited

U.S. PATENT DOCUMENTS 4,774,085 A 9/1988 Fidler
4,797,368 A 1/1989 Carter et al.
4,837,028 A 6/1989 Allen
4,873,316 A 10/1989 Meade et al.
4,880,635 A 11/1989 Janoff et al.
4,889,818 A 12/1989 Gelfand et al.
4,897,355 A 1/1990 Eppstein et al.
4,906,477 A 3/1990 Kurono et al.
4,911,928 A 3/1990 Wallach
4,917,951 A 4/1990 Wallach
4,920,016 A 4/1990 Allen et al.
4,921,757 A 5/1990 Wheatley et al.
4,946,787 A 8/1990 Eppstein et al.
4,965,185 A 10/1990 Grischenko et al.
5,017,492 A 5/1991 Kotewicz et al.
5,047,342 A 9/1991 Chatterjee
5,049,386 A 9/1991 Eppstein et al.
5,079,352 A 1/1992 Gelfand et al.
5,139,941 A 8/1992 Muzyczka et al.
5,173,414 A 12/1992 Lebkowski et al.
5,223,409 A 6/1993 Ladner et al.
5,244,797 A 9/1993 Kotewicz et al.
5,270,179 A 12/1993 Chatterjee
5,374,553 A 12/1994 Gelfand et al.
5,405,776 A 4/1995 Kotewicz et al.
5,436,149 A 7/1995 Barnes
5,449,639 A 9/1995 Wei et al.
5,478,745 A 12/1995 Samulski et al.
5,496,714 A 3/1996 Comb et al.
5,512,462 A 4/1996 Cheng
5,580,737 A 12/1996 Polisky et al.
5,614,365 A 3/1997 Tabor et al.
5,652,094 A 7/1997 Usman et al.
5,658,727 A 8/1997 Barbas et al.
5,668,005 A 9/1997 Kotewicz et al.
5,677,152 A 10/1997 Birch et al.
5,767,099 A 6/1998 Harris et al.
5,780,053 A 7/1998 Ashley et al.
5,830,430 A 11/1998 Unger et al.
5,834,247 A 11/1998 Comb et al.
5,835,699 A 11/1998 Kimura
5,844,075 A 12/1998 Kawakami et al.
5,849,548 A 12/1998 Haseloff et al.
5,851,548 A 12/1998 Dattagupta et al.
5,855,910 A 1/1999 Ashley et al.
5,856,463 A 1/1999 Blankenborg et al.
5,962,313 A 10/1999 Podsakoff et al.
5,981,182 A 11/1999 Jacobs, Jr. et al.
6,015,794 A 1/2000 Haseloff et al.
6,057,153 A 5/2000 George et al.
6,063,608 A 5/2000 Kotewicz et al.
6,077,705 A 6/2000 Duan et al.
6,099,857 A 8/2000 Gross
6,156,509 A 12/2000 Schellenberger
6,183,998 B1 2/2001 Ivanov et al.
6,355,415 B1 3/2002 Wagner et al.
6,416,997 B1 7/2002 Mir-Shekari et al.
6,429,298 B1 8/2002 Ellington et al.
6,453,242 B1 9/2002 Eisenberg et al.
6,479,264 B1 11/2002 Louwrier
6,503,717 B2 1/2003 Case et al.
6,534,261 B1 3/2003 Cox, III et al.
6,558,671 B1 5/2003 Slingluff et al.
6,589,768 B1 7/2003 Kotewicz et al.
6,599,692 B1 7/2003 Case et al.
6,607,882 B1 8/2003 Cox, III et al.
6,610,522 B1 8/2003 Kotewicz et al.
6,689,558 B2 2/2004 Case et al.
6,716,973 B2 4/2004 Baskerville et al.
6,815,194 B2 11/2004 Honjo et al.
6,824,978 B1 11/2004 Cox, III et al.
6,933,113 B2 8/2005 Case et al.
6,979,539 B2 12/2005 Cox, III et al.
7,013,219 B2 3/2006 Case et al.
7,045,337 B2 5/2006 Schultz et al.
7,067,650 B1 6/2006 Tanaka
7,070,928 B2 7/2006 Liu et al.
7,078,208 B2 7/2006 Smith et al.
7,083,970 B2 8/2006 Schultz et al.
7,163,824 B2 1/2007 Cox, III et al.
7,192,739 B2 3/2007 Liu et al.
7,223,545 B2 5/2007 Liu et al.
7,329,807 B2 2/2008 Vadrucci et al.
7,354,761 B2 4/2008 Schultz et al.
7,368,275 B2 5/2008 Schultz et al.
7,419,669 B2 9/2008 Kosmatopoulos et al.
7,442,160 B2 10/2008 Liu et al.
7,476,500 B1 1/2009 Liu et al.
7,476,734 B2 1/2009 Liu
7,479,573 B2 1/2009 Chu et al.
7,488,718 B2 2/2009 Scheinberg et al.
7,491,494 B2 2/2009 Liu et al.
7,510,706 B2 3/2009 Yonemitsu et al.
7,541,450 B2 6/2009 Liu et al.
7,556,940 B2 7/2009 Galarza et al.
7,557,068 B2 7/2009 Liu et al.
7,595,179 B2 9/2009 Chen et al.
7,638,300 B2 12/2009 Schultz et al.
7,670,807 B2 3/2010 Lampson et al.
7,678,554 B2 3/2010 Liu et al.
7,713,721 B2 5/2010 Schultz et al.
7,771,935 B2 8/2010 Liu et al.
7,794,931 B2 9/2010 Breaker et al.
7,807,408 B2 10/2010 Liu et al.
7,851,658 B2 12/2010 Liu et al.
7,915,025 B2 3/2011 Schultz et al.
7,919,277 B2 4/2011 Russell et al.
7,993,672 B2 8/2011 Huang et al.
7,998,904 B2 8/2011 Liu et al.
7,999,071 B2 8/2011 Schlom et al.
8,012,739 B2 9/2011 Schultz et al.
8,017,323 B2 9/2011 Liu et al.
8,017,755 B2 9/2011 Liu et al.
8,030,074 B2 10/2011 Schultz et al.
8,067,556 B2 11/2011 Hogrefe et al.
8,114,648 B2 2/2012 Schultz et al.
8,173,364 B2 5/2012 Schultz et al.
8,173,392 B2 5/2012 Schultz et al.
8,183,012 B2 5/2012 Schultz et al.
8,183,178 B2 5/2012 Liu et al.
8,206,914 B2 6/2012 Liu et al.
8,354,380 B2 1/2013 Liu et al.
8,361,725 B2 1/2013 Russell et al.
8,394,604 B2 3/2013 Liu et al.
8,420,104 B2 4/2013 Charneau et al.
8,440,431 B2 5/2013 Voytas et al.
8,440,432 B2 5/2013 Voytas et al.
8,450,471 B2 5/2013 Voytas et al.
8,492,082 B2 7/2013 De Franciscis et al.
8,546,553 B2 10/2013 Terns et al.
8,569,256 B2 10/2013 Heyes et al.
8,586,363 B2 11/2013 Voytas et al.
8,673,612 B2 3/2014 Klatzmann et al.
8,680,069 B2 3/2014 de Fougerolles et al.
8,691,729 B2 4/2014 Liu et al.
8,691,750 B2 4/2014 Constien et al.
8,697,359 B1 4/2014 Zhang
8,697,439 B2 4/2014 Mangeot et al.
8,697,853 B2 4/2014 Voytas et al.
8,709,466 B2 4/2014 Coady et al.
8,728,526 B2 5/2014 Heller
8,729,038 B2 5/2014 Gruber et al.
8,741,279 B2 6/2014 Kasahara et al.
8,748,667 B2 6/2014 Budzik et al.
8,758,810 B2 6/2014 Okada et al.
8,759,103 B2 6/2014 Kim et al.
8,759,104 B2 6/2014 Unciti-Broceta et al.
8,771,728 B2 7/2014 Huang et al.
8,790,664 B2 7/2014 Pitard et al.
8,795,965 B2 8/2014 Zhang
8,822,663 B2 9/2014 Schrum et al.
8,835,148 B2 9/2014 Janulaitis et al.
8,846,578 B2 9/2014 McCray et al.
8,871,445 B2 10/2014 Cong et al.

(56) References Cited

U.S. PATENT DOCUMENTS

| | | | |
|---|---|---|---|
| 8,889,418 | B2 | 11/2014 | Zhang et al. |
| 8,900,814 | B2 | 12/2014 | Yasukawa et al. |
| 8,945,839 | B2 | 2/2015 | Zhang |
| 8,975,232 | B2 | 3/2015 | Liu et al. |
| 8,993,233 | B2 | 3/2015 | Zhang et al. |
| 8,999,641 | B2 | 4/2015 | Zhang et al. |
| 9,023,594 | B2 | 5/2015 | Liu et al. |
| 9,023,649 | B2 | 5/2015 | Mali et al. |
| 9,034,650 | B2 | 5/2015 | Padidam |
| 9,068,179 | B1 | 6/2015 | Liu et al. |
| 9,150,626 | B2 | 10/2015 | Liu et al. |
| 9,163,271 | B2 | 10/2015 | Schultz et al. |
| 9,163,284 | B2 | 10/2015 | Liu et al. |
| 9,181,535 | B2 | 11/2015 | Liu et al. |
| 9,200,045 | B2 | 12/2015 | Liu et al. |
| 9,221,886 | B2 | 12/2015 | Liu et al. |
| 9,228,207 | B2 | 1/2016 | Liu et al. |
| 9,234,213 | B2 | 1/2016 | Wu |
| 9,243,038 | B2 | 1/2016 | Liu et al. |
| 9,267,127 | B2 | 2/2016 | Liu et al. |
| 9,290,773 | B2 | 3/2016 | Edgerton |
| 9,296,790 | B2 | 3/2016 | Chatterjee et al. |
| 9,322,006 | B2 | 4/2016 | Liu et al. |
| 9,322,037 | B2 | 4/2016 | Liu et al. |
| 9,340,799 | B2 | 5/2016 | Liu et al. |
| 9,340,800 | B2 | 5/2016 | Liu et al. |
| 9,359,599 | B2 | 6/2016 | Liu et al. |
| 9,388,430 | B2 | 7/2016 | Liu et al. |
| 9,394,537 | B2 | 7/2016 | Liu et al. |
| 9,434,774 | B2 | 9/2016 | Liu et al. |
| 9,458,484 | B2 | 10/2016 | Ma et al. |
| 9,512,446 | B1 | 12/2016 | Joung et al. |
| 9,526,784 | B2 | 12/2016 | Liu et al. |
| 9,534,210 | B2 | 1/2017 | Park et al. |
| 9,580,698 | B1 | 2/2017 | Xu et al. |
| 9,593,356 | B2 | 3/2017 | Haugwitz et al. |
| 9,610,322 | B2 | 4/2017 | Liu et al. |
| 9,637,739 | B2 | 5/2017 | Siksnys et al. |
| 9,663,770 | B2 | 5/2017 | Rogers et al. |
| 9,663,782 | B2 | 5/2017 | Yu et al. |
| 9,695,446 | B2 | 7/2017 | Mangeot et al. |
| 9,737,604 | B2 | 8/2017 | Jin et al. |
| 9,738,693 | B2 | 8/2017 | Telford et al. |
| 9,753,340 | B2 | 9/2017 | Saitou |
| 9,765,304 | B2 | 9/2017 | Klatzmann et al. |
| 9,771,574 | B2 | 9/2017 | Liu et al. |
| 9,777,043 | B2 | 10/2017 | Anderson et al. |
| 9,783,791 | B2 | 10/2017 | Hogrefe et al. |
| 9,816,093 | B1 | 11/2017 | Donohoue et al. |
| 9,840,538 | B2 | 12/2017 | Telford et al. |
| 9,840,690 | B2 | 12/2017 | Karli et al. |
| 9,840,699 | B2 | 12/2017 | Liu et al. |
| 9,840,702 | B2 | 12/2017 | Collingwood et al. |
| 9,850,521 | B2 | 12/2017 | Braman et al. |
| 9,873,907 | B2 | 1/2018 | Zeiner et al. |
| 9,879,270 | B2 | 1/2018 | Hittinger et al. |
| 9,914,939 | B2 | 3/2018 | Church et al. |
| 9,932,567 | B1 | 4/2018 | Xu et al. |
| 9,938,288 | B1 | 4/2018 | Kishi et al. |
| 9,944,933 | B2 | 4/2018 | Storici et al. |
| 9,982,279 | B1 | 5/2018 | Gill et al. |
| 9,999,671 | B2 | 6/2018 | Liu et al. |
| 10,011,868 | B2 | 7/2018 | Liu et al. |
| 10,040,830 | B2 | 8/2018 | Chatterjee et al. |
| 10,053,725 | B2 | 8/2018 | Liu et al. |
| 10,059,940 | B2 | 8/2018 | Zhong |
| 10,077,453 | B2 | 9/2018 | Liu et al. |
| 10,113,163 | B2 | 10/2018 | Liu et al. |
| 10,150,955 | B2 | 12/2018 | Lambowitz et al. |
| 10,167,457 | B2 | 1/2019 | Liu et al. |
| 10,179,911 | B2 | 1/2019 | Liu et al. |
| 10,189,831 | B2 | 1/2019 | Arrington et al. |
| 10,202,593 | B2 | 2/2019 | Liu et al. |
| 10,202,658 | B2 | 2/2019 | Parkin et al. |
| 10,227,581 | B2 | 3/2019 | Liu et al. |
| 10,323,236 | B2 | 6/2019 | Liu et al. |
| 10,336,997 | B2 | 7/2019 | Liu et al. |
| 10,358,670 | B2 | 7/2019 | Janulaitis et al. |
| 10,392,674 | B2 | 8/2019 | Liu et al. |
| 10,407,474 | B2 | 9/2019 | Liu et al. |
| 10,407,695 | B2 | 9/2019 | Charneau et al. |
| 10,407,697 | B2 | 9/2019 | Doudna et al. |
| 10,465,176 | B2 | 11/2019 | Liu et al. |
| 10,508,298 | B2 | 12/2019 | Liu et al. |
| 10,583,201 | B2 | 3/2020 | Chen et al. |
| 10,597,679 | B2 | 3/2020 | Liu et al. |
| 10,612,011 | B2 | 4/2020 | Liu et al. |
| 10,640,767 | B2 | 5/2020 | Maianti et al. |
| 10,682,410 | B2 | 6/2020 | Liu et al. |
| 10,704,062 | B2 | 7/2020 | Liu et al. |
| 10,745,677 | B2 | 8/2020 | Maianti et al. |
| 10,858,639 | B2 | 12/2020 | Liu et al. |
| 10,912,833 | B2 | 2/2021 | Liu et al. |
| 10,930,367 | B2 | 2/2021 | Zhang et al. |
| 10,947,530 | B2 | 3/2021 | Liu et al. |
| 10,954,548 | B2 | 3/2021 | Liu et al. |
| 10,968,253 | B2 | 4/2021 | Ohlmann et al. |
| 11,046,948 | B2 | 6/2021 | Liu et al. |
| 11,053,481 | B2 | 7/2021 | Liu et al. |
| 11,124,782 | B2 | 9/2021 | Liu et al. |
| 11,142,760 | B2 | 10/2021 | Slaymaker et al. |
| 11,214,780 | B2 | 1/2022 | Liu et al. |
| 11,268,082 | B2 | 3/2022 | Liu et al. |
| 11,299,755 | B2 | 4/2022 | Liu et al. |
| 11,306,324 | B2 | 4/2022 | Liu et al. |
| 11,319,532 | B2 | 5/2022 | Liu et al. |
| 11,447,770 | B1 | 9/2022 | Liu et al. |
| 11,542,496 | B2 | 1/2023 | Liu et al. |
| 11,542,509 | B2 | 1/2023 | Maianti et al. |
| 11,560,566 | B2 | 1/2023 | Liu et al. |
| 11,578,343 | B2 | 2/2023 | Liu et al. |
| 11,643,652 | B2 | 5/2023 | Liu et al. |
| 11,661,590 | B2 | 5/2023 | Liu et al. |
| 11,702,651 | B2 | 7/2023 | Liu et al. |
| 11,732,274 | B2 | 8/2023 | Liu et al. |
| 11,795,443 | B2 | 10/2023 | Liu et al. |
| 11,795,452 | B2 | 10/2023 | Liu et al. |
| 11,820,969 | B2 | 11/2023 | Maianti et al. |
| 11,898,179 | B2 | 2/2024 | Maianti et al. |
| 11,912,985 | B2 | 2/2024 | Liu et al. |
| 11,920,181 | B2 | 3/2024 | Liu et al. |
| 11,932,884 | B2 | 3/2024 | Liu et al. |
| 11,999,947 | B2 | 6/2024 | Liu et al. |
| 12,006,520 | B2 | 6/2024 | Liu et al. |
| 12,031,126 | B2 | 7/2024 | Liu et al. |
| 12,043,852 | B2 | 7/2024 | Liu et al. |
| 12,084,663 | B2 | 9/2024 | Maianti et al. |
| 12,157,760 | B2 | 12/2024 | Liu et al. |
| 12,215,365 | B2 | 2/2025 | Liu et al. |
| 12,281,303 | B2 | 4/2025 | Liu et al. |
| 12,281,338 | B2 | 4/2025 | Liu et al. |
| 12,344,869 | B2 | 7/2025 | Liu et al. |
| 12,351,837 | B2 | 7/2025 | Kim et al. |
| 12,359,218 | B2 | 7/2025 | Liu et al. |
| 12,390,514 | B2 | 8/2025 | Maianti et al. |
| 12,398,406 | B2 | 8/2025 | Liu et al. |
| 12,406,749 | B2 | 9/2025 | Shen et al. |
| 12,435,331 | B2 | 10/2025 | Liu et al. |
| 12,473,543 | B2 | 11/2025 | Liu et al. |
| 12,473,573 | B2 | 11/2025 | Liu et al. |
| 12,509,680 | B2 | 12/2025 | Liu et al. |
| 12,516,308 | B2 | 1/2026 | Maianti et al. |
| 12,522,807 | B2 | 1/2026 | Liu et al. |
| 2003/0082575 | A1 | 5/2003 | Schultz et al. |
| 2003/0087817 | A1 | 5/2003 | Cox et al. |
| 2003/0096337 | A1 | 5/2003 | Hillman et al. |
| 2003/0103939 | A1 | 6/2003 | Engelhardt et al. |
| 2003/0108885 | A1 | 6/2003 | Schultz et al. |
| 2003/0119764 | A1 | 6/2003 | Loeb et al. |
| 2003/0167533 | A1 | 9/2003 | Yadav et al. |
| 2003/0203480 | A1 | 10/2003 | Kovesdi et al. |
| 2004/0003420 | A1 | 1/2004 | Kuhn et al. |
| 2004/0028687 | A1 | 2/2004 | Waelti |
| 2004/0115184 | A1 | 6/2004 | Smith et al. |

(56) References Cited

U.S. PATENT DOCUMENTS

2004/0156861 A1 8/2004 Figdor et al.
2004/0197892 A1 10/2004 Moore et al.
2004/0203109 A1 10/2004 Lal et al.
2005/0100890 A1 5/2005 Davidson et al.
2005/0136429 A1 6/2005 Guarente et al.
2005/0222030 A1 10/2005 Allison
2005/0260626 A1 11/2005 Lorens et al.
2006/0088864 A1 4/2006 Smolke et al.
2006/0104984 A1 5/2006 Littlefield et al.
2006/0216702 A1 9/2006 Compans et al.
2006/0246568 A1 11/2006 Honjo et al.
2007/0015238 A1 1/2007 Snyder et al.
2007/0049533 A1 3/2007 Liu et al.
2007/0264692 A1 11/2007 Liu et al.
2007/0269817 A1 11/2007 Shapero
2007/0298118 A1 12/2007 Lotvall et al.
2008/0008697 A1 1/2008 Mintier et al.
2008/0051317 A1 2/2008 Church et al.
2008/0124725 A1 5/2008 Barrangou et al.
2008/0182254 A1 7/2008 Hall et al.
2008/0220502 A1 9/2008 Schellenberger et al.
2008/0241917 A1 10/2008 Akita et al.
2008/0268516 A1 10/2008 Perreault et al.
2009/0111119 A1 4/2009 Doyon et al.
2009/0130718 A1 5/2009 Short
2009/0202622 A1 8/2009 Fleury et al.
2009/0215878 A1 8/2009 Tan et al.
2009/0234109 A1 9/2009 Han et al.
2010/0076057 A1 3/2010 Sontheimer et al.
2010/0093617 A1 4/2010 Barrangou et al.
2010/0104690 A1 4/2010 Barrangou et al.
2010/0105134 A1 4/2010 Quay et al.
2010/0273857 A1 10/2010 Thakker et al.
2010/0305197 A1 12/2010 Che
2010/0316643 A1 12/2010 Eckert et al.
2011/0016540 A1 1/2011 Weinstein et al.
2011/0059160 A1 3/2011 Essner et al.
2011/0059502 A1 3/2011 Chalasani
2011/0077199 A1 3/2011 Schellenberger et al.
2011/0104787 A1 5/2011 Church et al.
2011/0123509 A1 5/2011 Jantz et al.
2011/0177495 A1 7/2011 Liu et al.
2011/0189775 A1 8/2011 Ainley et al.
2011/0189776 A1 8/2011 Terns et al.
2011/0206672 A1 8/2011 Little
2011/0217739 A1 9/2011 Terns et al.
2011/0301073 A1 12/2011 Gregory et al.
2012/0129759 A1 5/2012 Liu et al.
2012/0141523 A1 6/2012 Castado et al.
2012/0159653 A1 6/2012 Weinstein et al.
2012/0244601 A1 9/2012 Bertozzi et al.
2012/0270273 A1 10/2012 Zhang et al.
2012/0322861 A1 12/2012 Byrne et al.
2013/0022980 A1 1/2013 Nelson et al.
2013/0053426 A1 2/2013 Seow et al.
2013/0059931 A1 3/2013 Petersen-Mahrt et al.
2013/0108657 A1 5/2013 Yee et al.
2013/0117869 A1 5/2013 Duchateau et al.
2013/0130248 A1 5/2013 Haurwitz et al.
2013/0158245 A1 6/2013 Russell et al.
2013/0165389 A1 6/2013 Schellenberger et al.
2013/0212725 A1 8/2013 Kuhn et al.
2013/0309720 A1 11/2013 Schultz et al.
2013/0344117 A1 12/2013 Mirosevich et al.
2013/0345064 A1 12/2013 Liu et al.
2014/0004280 A1 1/2014 Loomis
2014/0005269 A1 1/2014 Ngwuluka et al.
2014/0017214 A1 1/2014 Cost
2014/0018404 A1 1/2014 Chen et al.
2014/0044793 A1 2/2014 Goll et al.
2014/0065711 A1 3/2014 Liu et al.
2014/0068797 A1 3/2014 Doudna et al.
2014/0127752 A1 5/2014 Zhou et al.
2014/0128449 A1 5/2014 Liu et al.
2014/0141094 A1 5/2014 Smyth et al.
2014/0141487 A1 5/2014 Feldman et al.
2014/0179770 A1 6/2014 Zhang et al.
2014/0186843 A1 7/2014 Zhang et al.
2014/0186919 A1 7/2014 Zhang et al.
2014/0186958 A1 7/2014 Zhang et al.
2014/0201858 A1 7/2014 Ostertag et al.
2014/0234289 A1 8/2014 Liu et al.
2014/0248702 A1 9/2014 Zhang et al.
2014/0256046 A1 9/2014 Zhang et al.
2014/0273037 A1 9/2014 Wu
2014/0273226 A1 9/2014 Wu
2014/0273230 A1 9/2014 Chen et al.
2014/0273234 A1 9/2014 Zhang et al.
2014/0283156 A1 9/2014 Zador et al.
2014/0295556 A1 10/2014 Joung et al.
2014/0295557 A1 10/2014 Joung et al.
2014/0342456 A1 11/2014 Mali et al.
2014/0342457 A1 11/2014 Mali et al.
2014/0342458 A1 11/2014 Mali et al.
2014/0349400 A1 11/2014 Jakimo et al.
2014/0356867 A1 12/2014 Peter et al.
2014/0356956 A1 12/2014 Church et al.
2014/0356958 A1 12/2014 Mali et al.
2014/0356959 A1 12/2014 Church et al.
2014/0357523 A1 12/2014 Zeiner et al.
2014/0377868 A1 12/2014 Joung et al.
2015/0010526 A1 1/2015 Liu et al.
2015/0031089 A1 1/2015 Lindstrom
2015/0031132 A1 1/2015 Church et al.
2015/0031133 A1 1/2015 Church et al.
2015/0044191 A1 2/2015 Liu et al.
2015/0044192 A1 2/2015 Liu et al.
2015/0044772 A1 2/2015 Zhao
2015/0050699 A1 2/2015 Siksnys et al.
2015/0056177 A1 2/2015 Liu et al.
2015/0056629 A1 2/2015 Guthrie-Honea
2015/0064138 A1 3/2015 Lu et al.
2015/0064789 A1 3/2015 Paschon et al.
2015/0071898 A1 3/2015 Liu et al.
2015/0071899 A1 3/2015 Liu et al.
2015/0071900 A1 3/2015 Liu et al.
2015/0071901 A1 3/2015 Liu et al.
2015/0071902 A1 3/2015 Liu et al.
2015/0071903 A1 3/2015 Liu et al.
2015/0071906 A1 3/2015 Liu et al.
2015/0079680 A1 3/2015 Bradley et al.
2015/0079681 A1 3/2015 Zhang
2015/0098954 A1 4/2015 Hyde et al.
2015/0118216 A1 4/2015 Liu et al.
2015/0128300 A1 5/2015 Warming et al.
2015/0132269 A1 5/2015 Orkin et al.
2015/0140664 A1 5/2015 Byrne et al.
2015/0159172 A1 6/2015 Miller et al.
2015/0165054 A1 6/2015 Liu et al.
2015/0166980 A1 6/2015 Liu et al.
2015/0166981 A1 6/2015 Liu et al.
2015/0166982 A1 6/2015 Liu et al.
2015/0166983 A1 6/2015 Liu et al.
2015/0166984 A1 6/2015 Liu et al.
2015/0166985 A1 6/2015 Liu et al.
2015/0191744 A1 7/2015 Wolfe et al.
2015/0197759 A1 7/2015 Xu et al.
2015/0211058 A1 7/2015 Carstens
2015/0218573 A1 8/2015 Loque et al.
2015/0225773 A1 8/2015 Farmer et al.
2015/0241440 A1 8/2015 Fasan et al.
2015/0252358 A1 9/2015 Maeder et al.
2015/0275202 A1 10/2015 Liu et al.
2015/0291965 A1 10/2015 Zhang et al.
2015/0307889 A1 10/2015 Petolino et al.
2015/0315252 A1 11/2015 Haugwitz et al.
2015/0344549 A1 12/2015 Muir et al.
2016/0017393 A1 1/2016 Jacobson et al.
2016/0017396 A1 1/2016 Cann et al.
2016/0032292 A1 2/2016 Storici et al.
2016/0032353 A1 2/2016 Braman et al.
2016/0040155 A1 2/2016 Maizels et al.
2016/0046952 A1 2/2016 Hittinger et al.
2016/0046961 A1 2/2016 Jinek et al.

(56) References Cited

U.S. PATENT DOCUMENTS

2016/0046962 A1 2/2016 May et al.
2016/0053272 A1 2/2016 Wurtzel et al.
2016/0053304 A1 2/2016 Wurtzel et al.
2016/0074535 A1 3/2016 Ranganathan et al.
2016/0076093 A1 3/2016 Shendure et al.
2016/0090603 A1 3/2016 Carnes et al.
2016/0090622 A1 3/2016 Liu et al.
2016/0115488 A1 4/2016 Zhang et al.
2016/0137716 A1 5/2016 El Andaloussi et al.
2016/0138046 A1 5/2016 Wu
2016/0153003 A1 6/2016 Joung et al.
2016/0186214 A1 6/2016 Brouns et al.
2016/0200779 A1 7/2016 Liu et al.
2016/0201040 A1 7/2016 Liu et al.
2016/0201089 A1 7/2016 Gersbach et al.
2016/0206566 A1 7/2016 Lu et al.
2016/0208243 A1 7/2016 Zhang et al.
2016/0208288 A1 7/2016 Liu et al.
2016/0215275 A1 7/2016 Zhong
2016/0215276 A1 7/2016 Liu et al.
2016/0215300 A1 7/2016 May et al.
2016/0244784 A1 8/2016 Jacobson et al.
2016/0244829 A1 8/2016 Bang et al.
2016/0264934 A1 9/2016 Giallourakis et al.
2016/0272593 A1 9/2016 Ritter et al.
2016/0272965 A1 9/2016 Zhang et al.
2016/0281072 A1 9/2016 Zhang
2016/0298136 A1 10/2016 Chen et al.
2016/0304846 A1 10/2016 Liu et al.
2016/0304855 A1 10/2016 Stark et al.
2016/0312304 A1 10/2016 Sorrentino et al.
2016/0319262 A1 11/2016 Doudna et al.
2016/0333389 A1 11/2016 Liu et al.
2016/0340622 A1 11/2016 Abdou
2016/0340661 A1 11/2016 Cong et al.
2016/0340662 A1 11/2016 Zhang et al.
2016/0345578 A1 12/2016 Barrangou et al.
2016/0346360 A1 12/2016 Quake et al.
2016/0346361 A1 12/2016 Quake et al.
2016/0346362 A1 12/2016 Quake et al.
2016/0348074 A1 12/2016 Quake et al.
2016/0348096 A1 12/2016 Liu et al.
2016/0350476 A1 12/2016 Quake et al.
2016/0355796 A1 12/2016 Davidson et al.
2016/0369262 A1 12/2016 Reik et al.
2017/0009224 A1 1/2017 Liu et al.
2017/0009242 A1 1/2017 McKinley et al.
2017/0014449 A1 1/2017 Bangera et al.
2017/0020922 A1 1/2017 Wagner et al.
2017/0022251 A1 1/2017 Rammensee et al.
2017/0037432 A1 2/2017 Donohoue et al.
2017/0044520 A1 2/2017 Liu et al.
2017/0044592 A1 2/2017 Peter et al.
2017/0053729 A1 2/2017 Kotani et al.
2017/0058271 A1 3/2017 Joung et al.
2017/0058272 A1 3/2017 Carter et al.
2017/0058298 A1 3/2017 Kennedy et al.
2017/0073663 A1 3/2017 Wang et al.
2017/0073670 A1 3/2017 Nishida et al.
2017/0087224 A1 3/2017 Quake
2017/0087225 A1 3/2017 Quake
2017/0088587 A1 3/2017 Quake
2017/0088828 A1 3/2017 Quake
2017/0107536 A1 4/2017 Zhang et al.
2017/0107560 A1 4/2017 Peter et al.
2017/0112773 A1 4/2017 Stachowiak et al.
2017/0114367 A1 4/2017 Hu et al.
2017/0121693 A1 5/2017 Liu et al.
2017/0145394 A1 5/2017 Yeo et al.
2017/0145405 A1 5/2017 Tang et al.
2017/0145438 A1 5/2017 Kantor
2017/0152528 A1 6/2017 Zhang
2017/0152787 A1 6/2017 Kubo et al.
2017/0159033 A1 6/2017 Kamtekar et al.
2017/0166928 A1 6/2017 Vyas et al.
2017/0173113 A1 6/2017 Besner et al.
2017/0175086 A1 6/2017 Schmitt et al.
2017/0175104 A1 6/2017 Doudna et al.
2017/0175142 A1 6/2017 Zhang et al.
2017/0191047 A1 7/2017 Terns et al.
2017/0191078 A1 7/2017 Zhang et al.
2017/0198269 A1 7/2017 Zhang et al.
2017/0198277 A1 7/2017 Kmiec et al.
2017/0198302 A1 7/2017 Feng et al.
2017/0211061 A1 7/2017 Weiss et al.
2017/0224843 A1 8/2017 Deglon et al.
2017/0226522 A1 8/2017 Hu et al.
2017/0233703 A1 8/2017 Xie et al.
2017/0233708 A1 8/2017 Liu et al.
2017/0233756 A1 8/2017 Begemann et al.
2017/0247671 A1 8/2017 Yung et al.
2017/0247703 A1 8/2017 Sloan et al.
2017/0268022 A1 9/2017 Liu et al.
2017/0275648 A1 9/2017 Barrangou et al.
2017/0275665 A1 9/2017 Silas et al.
2017/0283797 A1 10/2017 Robb et al.
2017/0283831 A1 10/2017 Zhang et al.
2017/0306306 A1 10/2017 Potter et al.
2017/0314016 A1 11/2017 Kim et al.
2017/0362635 A1 12/2017 Chamberlain et al.
2018/0023062 A1 1/2018 Lamb et al.
2018/0037877 A1 2/2018 Gao et al.
2018/0064077 A1 3/2018 Dunham et al.
2018/0066258 A1 3/2018 Powell
2018/0068062 A1 3/2018 Zhang et al.
2018/0073012 A1 3/2018 Liu et al.
2018/0080051 A1 3/2018 Sheikh et al.
2018/0087046 A1 3/2018 Badran et al.
2018/0100147 A1 4/2018 Yates et al.
2018/0105867 A1 4/2018 Xiao et al.
2018/0119118 A1 5/2018 Lu et al.
2018/0127759 A1 5/2018 Lu et al.
2018/0127780 A1 5/2018 Liu et al.
2018/0155708 A1 6/2018 Church et al.
2018/0155720 A1 6/2018 Donohoue et al.
2018/0163213 A1 6/2018 Aneja et al.
2018/0170984 A1 6/2018 Harris et al.
2018/0177727 A1 6/2018 Kalluri et al.
2018/0179503 A1 6/2018 Maianti et al.
2018/0179547 A1 6/2018 Zhang et al.
2018/0201921 A1 7/2018 Malcolm
2018/0230464 A1 8/2018 Zhong
2018/0230471 A1 8/2018 Storici et al.
2018/0236081 A1 8/2018 Liu et al.
2018/0237787 A1 8/2018 Maianti et al.
2018/0245066 A1 8/2018 Yao et al.
2018/0245075 A1 8/2018 Khalil et al.
2018/0258418 A1 9/2018 Kim
2018/0265864 A1 9/2018 Li et al.
2018/0273935 A1 9/2018 Lane et al.
2018/0273939 A1 9/2018 Yu et al.
2018/0273976 A1 9/2018 Ümit et al.
2018/0282722 A1 10/2018 Jakimo et al.
2018/0298391 A1 10/2018 Jakimo et al.
2018/0305688 A1 10/2018 Zhong
2018/0305704 A1 10/2018 Zhang
2018/0312822 A1 11/2018 Lee et al.
2018/0312825 A1 11/2018 Liu et al.
2018/0312828 A1 11/2018 Liu et al.
2018/0312835 A1 11/2018 Yao et al.
2018/0327756 A1 11/2018 Zhang et al.
2018/0346927 A1 12/2018 Doudna et al.
2018/0371497 A1 12/2018 Gill et al.
2019/0010481 A1 1/2019 Joung et al.
2019/0032053 A1 1/2019 Ji et al.
2019/0055543 A1 2/2019 Tran et al.
2019/0055549 A1 2/2019 Capurso et al.
2019/0062734 A1 2/2019 Cotta-Ramusino et al.
2019/0093099 A1 3/2019 Liu et al.
2019/0119701 A1 4/2019 Liang et al.
2019/0135869 A1 5/2019 Chatterjee et al.
2019/0167810 A1 6/2019 Hean et al.
2019/0185883 A1 6/2019 Liu et al.
2019/0203228 A1 7/2019 Bouille et al.

(56) References Cited

U.S. PATENT DOCUMENTS

| | | | |
|---|---|---|---|
| 2019/0218547 | A1 | 7/2019 | Lee et al. |
| 2019/0224331 | A1 | 7/2019 | Wiklander |
| 2019/0225955 | A1 | 7/2019 | Liu et al. |
| 2019/0233814 | A1 | 8/2019 | Zhang et al. |
| 2019/0233847 | A1 | 8/2019 | Savage et al. |
| 2019/0241633 | A1 | 8/2019 | Fotin-Mleczek et al. |
| 2019/0256842 | A1 | 8/2019 | Liu et al. |
| 2019/0264202 | A1 | 8/2019 | Church et al. |
| 2019/0276816 | A1 | 9/2019 | Liu et al. |
| 2019/0309290 | A1 | 10/2019 | Neuteboom et al. |
| 2019/0322992 | A1 | 10/2019 | Liu et al. |
| 2019/0330619 | A1 | 10/2019 | Smith et al. |
| 2019/0352632 | A1 | 11/2019 | Liu et al. |
| 2019/0367891 | A1 | 12/2019 | Liu et al. |
| 2019/0388347 | A1 | 12/2019 | Wiklander et al. |
| 2020/0010818 | A1 | 1/2020 | Liu et al. |
| 2020/0010835 | A1 | 1/2020 | Maianti et al. |
| 2020/0023012 | A1 | 1/2020 | Joseph et al. |
| 2020/0056206 | A1 | 2/2020 | Tremblay et al. |
| 2020/0060980 | A1 | 2/2020 | Von Maltzahn et al. |
| 2020/0062813 | A1 | 2/2020 | Nordin et al. |
| 2020/0063127 | A1 | 2/2020 | Lu et al. |
| 2020/0071722 | A1 | 3/2020 | Liu et al. |
| 2020/0109398 | A1 | 4/2020 | Rubens et al. |
| 2020/0157570 | A1 | 5/2020 | Loiler |
| 2020/0172931 | A1 | 6/2020 | Liu et al. |
| 2020/0181619 | A1 | 6/2020 | Tang et al. |
| 2020/0190493 | A1 | 6/2020 | Liu et al. |
| 2020/0206360 | A1 | 7/2020 | Choi et al. |
| 2020/0216833 | A1 | 7/2020 | Liu et al. |
| 2020/0248156 | A1 | 8/2020 | Joung et al. |
| 2020/0255868 | A1 | 8/2020 | Liu et al. |
| 2020/0277587 | A1 | 9/2020 | Liu et al. |
| 2020/0291072 | A1 | 9/2020 | Wang et al. |
| 2020/0308571 | A1 | 10/2020 | Joung et al. |
| 2020/0318116 | A1 | 10/2020 | Freier |
| 2020/0323984 | A1 | 10/2020 | Liu et al. |
| 2020/0347100 | A1 | 11/2020 | Zhang |
| 2020/0399619 | A1 | 12/2020 | Maianti et al. |
| 2020/0399626 | A1 | 12/2020 | Liu et al. |
| 2020/0405639 | A1 | 12/2020 | Zhang et al. |
| 2020/0407418 | A1 | 12/2020 | Nordin et al. |
| 2021/0054416 | A1 | 2/2021 | Liu et al. |
| 2021/0069254 | A1 | 3/2021 | Görgens et al. |
| 2021/0115428 | A1 | 4/2021 | Maianti et al. |
| 2021/0137839 | A1 | 5/2021 | Von Maltzahn et al. |
| 2021/0171929 | A1 | 6/2021 | Gao et al. |
| 2021/0187018 | A1 | 6/2021 | Von Maltzahn et al. |
| 2021/0188903 | A1 | 6/2021 | Wiklander et al. |
| 2021/0189432 | A1 | 6/2021 | Shepherd et al. |
| 2021/0196809 | A1 | 7/2021 | Maianti et al. |
| 2021/0198330 | A1 | 7/2021 | Liu et al. |
| 2021/0198698 | A1 | 7/2021 | Von Maltzahn et al. |
| 2021/0214698 | A1 | 7/2021 | Liu et al. |
| 2021/0214713 | A9 | 7/2021 | Bashor et al. |
| 2021/0228627 | A1 | 7/2021 | Von Maltzahn et al. |
| 2021/0230577 | A1 | 7/2021 | Liu et al. |
| 2021/0254127 | A1 | 8/2021 | Liu et al. |
| 2021/0261957 | A1 | 8/2021 | Petris et al. |
| 2021/0269790 | A1 | 9/2021 | Hotta et al. |
| 2021/0284697 | A1 | 9/2021 | Ohlmann et al. |
| 2021/0292753 | A1 | 9/2021 | Halperin et al. |
| 2021/0315994 | A1 | 10/2021 | Liu et al. |
| 2021/0317440 | A1 | 10/2021 | Liu et al. |
| 2021/0347829 | A1 | 11/2021 | Malone et al. |
| 2021/0353543 | A1 | 11/2021 | Trudeau et al. |
| 2021/0380955 | A1 | 12/2021 | Bryson et al. |
| 2022/0008557 | A1 | 1/2022 | Von Maltzahn et al. |
| 2022/0033785 | A1 | 2/2022 | Liu et al. |
| 2022/0098593 | A1 | 3/2022 | Gaudelli et al. |
| 2022/0119785 | A1 | 4/2022 | Liu et al. |
| 2022/0154158 | A1 | 5/2022 | Charpentier et al. |
| 2022/0154224 | A1 | 5/2022 | Abudayyeh et al. |
| 2022/0170013 | A1 | 6/2022 | Liu et al. |
| 2022/0177877 | A1 | 6/2022 | Church et al. |
| 2022/0186216 | A1 | 6/2022 | Dokshin et al. |
| 2022/0204975 | A1 | 6/2022 | Liu et al. |
| 2022/0213507 | A1 | 7/2022 | Liu et al. |
| 2022/0220462 | A1 | 7/2022 | Liu et al. |
| 2022/0238182 | A1 | 7/2022 | Shen et al. |
| 2022/0282275 | A1 | 9/2022 | Liu et al. |
| 2022/0290115 | A1 | 9/2022 | Liu et al. |
| 2022/0307001 | A1 | 9/2022 | Liu et al. |
| 2022/0307003 | A1 | 9/2022 | Liu et al. |
| 2022/0315906 | A1 | 10/2022 | Liu et al. |
| 2022/0356469 | A1 | 11/2022 | Liu et al. |
| 2022/0380740 | A1 | 12/2022 | Liu et al. |
| 2022/0389395 | A1 | 12/2022 | Liu et al. |
| 2023/0002745 | A1 | 1/2023 | Liu et al. |
| 2023/0021641 | A1 | 1/2023 | Liu et al. |
| 2023/0056852 | A1 | 2/2023 | Liu et al. |
| 2023/0058176 | A1 | 2/2023 | Liu et al. |
| 2023/0078265 | A1 | 3/2023 | Liu et al. |
| 2023/0086199 | A1 | 3/2023 | Liu et al. |
| 2023/0090221 | A1 | 3/2023 | Liu et al. |
| 2023/0108687 | A1 | 4/2023 | Liu et al. |
| 2023/0123669 | A1 | 4/2023 | Liu et al. |
| 2023/0127008 | A1 | 4/2023 | Liu et al. |
| 2023/0159913 | A1 | 5/2023 | Liu et al. |
| 2023/0193295 | A1 | 6/2023 | Maianti et al. |
| 2023/0220374 | A1 | 7/2023 | Liu et al. |
| 2023/0272425 | A1 | 8/2023 | Liu et al. |
| 2023/0279443 | A1 | 9/2023 | Liu et al. |
| 2023/0332144 | A1 | 10/2023 | Liu et al. |
| 2023/0340465 | A1 | 10/2023 | Liu et al. |
| 2023/0340466 | A1 | 10/2023 | Liu et al. |
| 2023/0340467 | A1 | 10/2023 | Liu et al. |
| 2023/0348883 | A1 | 11/2023 | Liu et al. |
| 2023/0357766 | A1 | 11/2023 | Liu et al. |
| 2023/0383289 | A1 | 11/2023 | Liu et al. |
| 2024/0035017 | A1 | 2/2024 | Liu et al. |
| 2024/0076652 | A1 | 3/2024 | Liu et al. |
| 2024/0110166 | A1 | 4/2024 | Maianti et al. |
| 2024/0124866 | A1 | 4/2024 | Liu et al. |
| 2024/0173430 | A1 | 5/2024 | Liu et al. |
| 2024/0209329 | A1 | 6/2024 | Liu et al. |
| 2024/0229077 | A1 | 7/2024 | Liu et al. |
| 2024/0271116 | A1 | 8/2024 | Maianti et al. |
| 2024/0287487 | A1 | 8/2024 | Liu et al. |
| 2024/0327872 | A1 | 10/2024 | Liu et al. |
| 2024/0401018 | A1 | 12/2024 | Liu et al. |
| 2024/0417715 | A1 | 12/2024 | Liu et al. |
| 2024/0417719 | A1 | 12/2024 | Liu et al. |
| 2024/0417753 | A1 | 12/2024 | Liu et al. |
| 2025/0011748 | A1 | 1/2025 | Liu et al. |
| 2025/0027114 | A1 | 1/2025 | Liu et al. |
| 2025/0034549 | A1 | 1/2025 | Liu et al. |
| 2025/0059244 | A1 | 2/2025 | Liu et al. |
| 2025/0064979 | A1 | 2/2025 | Liu et al. |
| 2025/0064981 | A1 | 2/2025 | Liu et al. |
| 2025/0084399 | A1 | 3/2025 | Liu et al. |
| 2025/0084400 | A1 | 3/2025 | Liu et al. |
| 2025/0090687 | A1 | 3/2025 | Liu et al. |
| 2025/0092374 | A1 | 3/2025 | Liu et al. |
| 2025/0092382 | A1 | 3/2025 | Liu et al. |
| 2025/0101395 | A1 | 3/2025 | Liu et al. |
| 2025/0215418 | A1 | 7/2025 | Liu et al. |
| 2025/0228981 | A1 | 7/2025 | Liu et al. |
| 2025/0236855 | A1 | 7/2025 | Liu et al. |
| 2025/0263680 | A1 | 8/2025 | Liu et al. |
| 2025/0270527 | A1 | 8/2025 | Liu et al. |
| 2025/0270593 | A1 | 8/2025 | Liu et al. |
| 2025/0313821 | A1 | 10/2025 | Liu et al. |
| 2025/0327045 | A1 | 10/2025 | Liu et al. |
| 2025/0333718 | A1 | 10/2025 | Liu et al. |
| 2025/0382334 | A1 | 12/2025 | Liu et al. |
| 2026/0009027 | A1 | 1/2026 | Liu et al. |

FOREIGN PATENT DOCUMENTS

| | | | |
|---|---|---|---|
| AU | 2015101792 | A4 | 1/2016 |
| AU | 2012354062 | B2 | 9/2017 |
| BR | 112015013786 | A2 | 7/2017 |
| CA | 2480696 | A1 | 10/2003 |

(56) References Cited

FOREIGN PATENT DOCUMENTS

| | | | |
|---|---|---|---|
| CA | 2894668 | A1 | 6/2014 |
| CA | 2894681 | A1 | 6/2014 |
| CA | 2894684 | A1 | 6/2014 |
| CA | 2852593 | A1 | 11/2015 |
| CA | 3193022 | A1 | 3/2022 |
| CA | 3219487 | A1 | 12/2022 |
| CA | 2865578 | C | 1/2023 |
| CN | 1069962 | A | 3/1993 |
| CN | 101460619 | A | 6/2009 |
| CN | 101873862 | A | 10/2010 |
| CN | 102057039 | A | 5/2011 |
| CN | 102892777 | A | 1/2013 |
| CN | 103088008 | A | 5/2013 |
| CN | 103224947 | A | 7/2013 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 103911376 | A | 7/2014 |
| CN | 103923911 | A | 7/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 10445077 | A | 3/2015 |
| CN | 104404036 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104725626 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105121648 | A | 12/2015 |
| CN | 105132427 | A | 12/2015 |
| CN | 105132451 | A | 12/2015 |
| CN | 105177038 | A | 12/2015 |
| CN | 105177126 | A | 12/2015 |
| CN | 105210981 | A | 1/2016 |
| CN | 105219799 | A | 1/2016 |
| CN | 105238806 | A | 1/2016 |
| CN | 105255937 | A | 1/2016 |
| CN | 105274144 | A | 1/2016 |
| CN | 105296518 | A | 2/2016 |
| CN | 105296537 | A | 2/2016 |
| CN | 105316324 | A | 2/2016 |
| CN | 105316327 | A | 2/2016 |
| CN | 105316337 | A | 2/2016 |
| CN | 105331607 | A | 2/2016 |
| CN | 105331608 | A | 2/2016 |
| CN | 105331609 | A | 2/2016 |
| CN | 105331627 | A | 2/2016 |
| CN | 105400773 | A | 3/2016 |
| CN | 105400779 | A | 3/2016 |
| CN | 105400810 | A | 3/2016 |
| CN | 105441451 | A | 3/2016 |
| CN | 105462968 | A | 4/2016 |
| CN | 105463003 | A | 4/2016 |
| CN | 105463027 | A | 4/2016 |
| CN | 105492608 | A | 4/2016 |
| CN | 105492609 | A | 4/2016 |
| CN | 105505976 | A | 4/2016 |
| CN | 105505979 | A | 4/2016 |
| CN | 105518134 | A | 4/2016 |
| CN | 105518135 | A | 4/2016 |
| CN | 105518137 | A | 4/2016 |
| CN | 105518138 | A | 4/2016 |
| CN | 105518139 | A | 4/2016 |
| CN | 105518140 | A | 4/2016 |
| CN | 105543228 | A | 5/2016 |
| CN | 105543266 | A | 5/2016 |
| CN | 105543270 | A | 5/2016 |
| CN | 105567688 | A | 5/2016 |
| CN | 105567689 | A | 5/2016 |
| CN | 105567734 | A | 5/2016 |
| CN | 105567735 | A | 5/2016 |
| CN | 105567738 | A | 5/2016 |
| CN | 105593367 | A | 5/2016 |
| CN | 105594664 | A | 5/2016 |
| CN | 105602987 | A | 5/2016 |
| CN | 105624146 | A | 6/2016 |
| CN | 105624187 | A | 6/2016 |
| CN | 105646719 | A | 6/2016 |
| CN | 105647922 | A | 6/2016 |
| CN | 105647962 | A | 6/2016 |
| CN | 105647968 | A | 6/2016 |
| CN | 105647969 | A | 6/2016 |
| CN | 105671070 | A | 6/2016 |
| CN | 105671083 | A | 6/2016 |
| CN | 105695485 | A | 6/2016 |
| CN | 105779448 | A | 7/2016 |
| CN | 105779449 | A | 7/2016 |
| CN | 105802980 | A | 7/2016 |
| CN | 105821039 | A | 8/2016 |
| CN | 105821040 | A | 8/2016 |
| CN | 105821049 | A | 8/2016 |
| CN | 105821072 | A | 8/2016 |
| CN | 105821075 | A | 8/2016 |
| CN | 105821116 | A | 8/2016 |
| CN | 105838733 | A | 8/2016 |
| CN | 105861547 | A | 8/2016 |
| CN | 105861552 | A | 8/2016 |
| CN | 105861554 | A | 8/2016 |
| CN | 105886498 | A | 8/2016 |
| CN | 105886534 | A | 8/2016 |
| CN | 105886616 | A | 8/2016 |
| CN | 105907758 | A | 8/2016 |
| CN | 105907785 | A | 8/2016 |
| CN | 105925608 | A | 9/2016 |
| CN | 105934516 | A | 9/2016 |
| CN | 105950560 | A | 9/2016 |
| CN | 105950626 | A | 9/2016 |
| CN | 105950633 | A | 9/2016 |
| CN | 105950639 | A | 9/2016 |
| CN | 105985985 | A | 10/2016 |
| CN | 106011104 | A | 10/2016 |
| CN | 106011150 | A | 10/2016 |
| CN | 106011167 | A | 10/2016 |
| CN | 106011171 | A | 10/2016 |
| CN | 106032540 | A | 10/2016 |
| CN | 106047803 | A | 10/2016 |

(56) References Cited

FOREIGN PATENT DOCUMENTS

| | | | |
|---|---|---|---|
| CN | 106047877 | A | 10/2016 |
| CN | 106047930 | A | 10/2016 |
| CN | 106086008 | A | 11/2016 |
| CN | 106086028 | A | 11/2016 |
| CN | 106086061 | A | 11/2016 |
| CN | 106086062 | A | 11/2016 |
| CN | 106103475 | A | 11/2016 |
| CN | 106109417 | A | 11/2016 |
| CN | 106119275 | A | 11/2016 |
| CN | 106119283 | A | 11/2016 |
| CN | 106148286 | A | 11/2016 |
| CN | 106148370 | A | 11/2016 |
| CN | 106148416 | A | 11/2016 |
| CN | 106167525 | A | 11/2016 |
| CN | 106167808 | A | 11/2016 |
| CN | 106167810 | A | 11/2016 |
| CN | 106167821 | A | 11/2016 |
| CN | 106172238 | A | 12/2016 |
| CN | 106190903 | A | 12/2016 |
| CN | 106191057 | A | 12/2016 |
| CN | 106191061 | A | 12/2016 |
| CN | 106191062 | A | 12/2016 |
| CN | 106191064 | A | 12/2016 |
| CN | 106191071 | A | 12/2016 |
| CN | 106191099 | A | 12/2016 |
| CN | 106191107 | A | 12/2016 |
| CN | 106191113 | A | 12/2016 |
| CN | 106191114 | A | 12/2016 |
| CN | 106191116 | A | 12/2016 |
| CN | 106191124 | A | 12/2016 |
| CN | 106222177 | A | 12/2016 |
| CN | 106222193 | A | 12/2016 |
| CN | 106222203 | A | 12/2016 |
| CN | 106232823 | A | 12/2016 |
| CN | 106244555 | A | 12/2016 |
| CN | 106244557 | A | 12/2016 |
| CN | 106244591 | A | 12/2016 |
| CN | 106244609 | A | 12/2016 |
| CN | 106282241 | A | 1/2017 |
| CN | 106318934 | A | 1/2017 |
| CN | 106318973 | A | 1/2017 |
| CN | 106350540 | A | 1/2017 |
| CN | 106367435 | A | 2/2017 |
| CN | 106399306 | A | 2/2017 |
| CN | 106399311 | A | 2/2017 |
| CN | 106399360 | A | 2/2017 |
| CN | 106399367 | A | 2/2017 |
| CN | 106399375 | A | 2/2017 |
| CN | 106399377 | A | 2/2017 |
| CN | 106434651 | A | 2/2017 |
| CN | 106434663 | A | 2/2017 |
| CN | 106434688 | A | 2/2017 |
| CN | 106434737 | A | 2/2017 |
| CN | 106434748 | A | 2/2017 |
| CN | 106434752 | A | 2/2017 |
| CN | 106434782 | A | 2/2017 |
| CN | 106446600 | A | 2/2017 |
| CN | 106479985 | A | 3/2017 |
| CN | 106480027 | A | 3/2017 |
| CN | 106480036 | A | 3/2017 |
| CN | 106480067 | A | 3/2017 |
| CN | 106480080 | A | 3/2017 |
| CN | 106480083 | A | 3/2017 |
| CN | 106480097 | A | 3/2017 |
| CN | 106544351 | A | 3/2017 |
| CN | 106544353 | A | 3/2017 |
| CN | 106544357 | A | 3/2017 |
| CN | 106554969 | A | 4/2017 |
| CN | 106566838 | A | 4/2017 |
| CN | 106701763 | A | 5/2017 |
| CN | 106701808 | A | 5/2017 |
| CN | 106701818 | A | 5/2017 |
| CN | 106701823 | A | 5/2017 |
| CN | 106701830 | A | 5/2017 |
| CN | 106754912 | A | 5/2017 |
| CN | 106755026 | A | 5/2017 |
| CN | 106755077 | A | 5/2017 |
| CN | 106755088 | A | 5/2017 |
| CN | 106755091 | A | 5/2017 |
| CN | 106755097 | A | 5/2017 |
| CN | 106755424 | A | 5/2017 |
| CN | 106801056 | A | 6/2017 |
| CN | 106834323 | A | 6/2017 |
| CN | 106834341 | A | 6/2017 |
| CN | 106834347 | A | 6/2017 |
| CN | 106845151 | A | 6/2017 |
| CN | 106868008 | A | 6/2017 |
| CN | 106868031 | A | 6/2017 |
| CN | 106906240 | A | 6/2017 |
| CN | 106906242 | A | 6/2017 |
| CN | 106916820 | A | 7/2017 |
| CN | 106916852 | A | 7/2017 |
| CN | 106939303 | A | 7/2017 |
| CN | 106947750 | A | 7/2017 |
| CN | 106947780 | A | 7/2017 |
| CN | 106957830 | A | 7/2017 |
| CN | 106957831 | A | 7/2017 |
| CN | 106957844 | A | 7/2017 |
| CN | 106957855 | A | 7/2017 |
| CN | 106957858 | A | 7/2017 |
| CN | 106967697 | A | 7/2017 |
| CN | 106967726 | A | 7/2017 |
| CN | 106978428 | A | 7/2017 |
| CN | 106987570 | A | 7/2017 |
| CN | 106987757 | A | 7/2017 |
| CN | 107012164 | A | 8/2017 |
| CN | 107012174 | A | 8/2017 |
| CN | 107012213 | A | 8/2017 |
| CN | 107012250 | A | 8/2017 |
| CN | 107022562 | A | 8/2017 |
| CN | 107034188 | A | 8/2017 |
| CN | 107034218 | A | 8/2017 |
| CN | 107034229 | A | 8/2017 |
| CN | 107043775 | A | 8/2017 |
| CN | 107043779 | A | 8/2017 |
| CN | 107043787 | A | 8/2017 |
| CN | 107058320 | A | 8/2017 |
| CN | 107058328 | A | 8/2017 |
| CN | 107058358 | A | 8/2017 |
| CN | 107058372 | A | 8/2017 |
| CN | 107083392 | A | 8/2017 |
| CN | 107099533 | A | 8/2017 |
| CN | 107099850 | A | 8/2017 |
| CN | 107119053 | A | 9/2017 |
| CN | 107119071 | A | 9/2017 |
| CN | 107129999 | A | 9/2017 |
| CN | 107130000 | A | 9/2017 |
| CN | 107142272 | A | 9/2017 |
| CN | 107142282 | A | 9/2017 |
| CN | 107177591 | A | 9/2017 |
| CN | 107177595 | A | 9/2017 |
| CN | 107177625 | A | 9/2017 |
| CN | 107177631 | A | 9/2017 |
| CN | 107190006 | A | 9/2017 |
| CN | 107190008 | A | 9/2017 |
| CN | 107217042 | A | 9/2017 |
| CN | 107217075 | A | 9/2017 |
| CN | 107227307 | A | 10/2017 |
| CN | 107227352 | A | 10/2017 |
| CN | 107236737 | A | 10/2017 |
| CN | 107236739 | A | 10/2017 |
| CN | 107236741 | A | 10/2017 |
| CN | 107245502 | A | 10/2017 |
| CN | 107254485 | A | 10/2017 |
| CN | 107266541 | A | 10/2017 |
| CN | 107267515 | A | 10/2017 |
| CN | 107287245 | A | 10/2017 |
| CN | 107298701 | A | 10/2017 |
| CN | 107299114 | A | 10/2017 |
| CN | 107304435 | A | 10/2017 |
| CN | 107312785 | A | 11/2017 |
| CN | 107312793 | A | 11/2017 |
| CN | 107312795 | A | 11/2017 |
| CN | 107312798 | A | 11/2017 |

(56) References Cited

FOREIGN PATENT DOCUMENTS

| | | | |
|---|---|---|---|
| CN | 107326042 | A | 11/2017 |
| CN | 107326046 | A | 11/2017 |
| CN | 107354156 | A | 11/2017 |
| CN | 107354173 | A | 11/2017 |
| CN | 107356793 | A | 11/2017 |
| CN | 107362372 | A | 11/2017 |
| CN | 107365786 | A | 11/2017 |
| CN | 107365804 | A | 11/2017 |
| CN | 107384894 | A | 11/2017 |
| CN | 107384922 | A | 11/2017 |
| CN | 107384926 | A | 11/2017 |
| CN | 107400677 | A | 11/2017 |
| CN | 107418974 | A | 12/2017 |
| CN | 107435051 | A | 12/2017 |
| CN | 107435069 | A | 12/2017 |
| CN | 107446922 | A | 12/2017 |
| CN | 107446923 | A | 12/2017 |
| CN | 107446924 | A | 12/2017 |
| CN | 107446932 | A | 12/2017 |
| CN | 107446951 | A | 12/2017 |
| CN | 107446954 | A | 12/2017 |
| CN | 107460196 | A | 12/2017 |
| CN | 107474129 | A | 12/2017 |
| CN | 107475300 | A | 12/2017 |
| CN | 107488649 | A | 12/2017 |
| CN | 107502608 | A | 12/2017 |
| CN | 107502618 | A | 12/2017 |
| CN | 107513531 | A | 12/2017 |
| CN | 107519492 | A | 12/2017 |
| CN | 107523567 | A | 12/2017 |
| CN | 107523583 | A | 12/2017 |
| CN | 107541525 | A | 1/2018 |
| CN | 107557373 | A | 1/2018 |
| CN | 107557378 | A | 1/2018 |
| CN | 107557381 | A | 1/2018 |
| CN | 107557390 | A | 1/2018 |
| CN | 107557393 | A | 1/2018 |
| CN | 107557394 | A | 1/2018 |
| CN | 107557455 | A | 1/2018 |
| CN | 107574179 | A | 1/2018 |
| CN | 107586777 | A | 1/2018 |
| CN | 107586779 | A | 1/2018 |
| CN | 107604003 | A | 1/2018 |
| CN | 107619829 | A | 1/2018 |
| CN | 107619837 | A | 1/2018 |
| CN | 107630006 | A | 1/2018 |
| CN | 107630041 | A | 1/2018 |
| CN | 107630042 | A | 1/2018 |
| CN | 107630043 | A | 1/2018 |
| CN | 107641631 | A | 1/2018 |
| CN | 107653256 | A | 2/2018 |
| CN | 107686848 | A | 2/2018 |
| CN | 206970581 | A | 2/2018 |
| CN | 107760652 | A | 3/2018 |
| CN | 107760663 | A | 3/2018 |
| CN | 107760684 | A | 3/2018 |
| CN | 107760715 | A | 3/2018 |
| CN | 107784200 | A | 3/2018 |
| CN | 107794272 | A | 3/2018 |
| CN | 107794276 | A | 3/2018 |
| CN | 107815463 | A | 3/2018 |
| CN | 107828738 | A | 3/2018 |
| CN | 107828794 | A | 3/2018 |
| CN | 107828826 | A | 3/2018 |
| CN | 107828874 | A | 3/2018 |
| CN | 107858346 | A | 3/2018 |
| CN | 107858373 | A | 3/2018 |
| CN | 107880132 | A | 4/2018 |
| CN | 107881184 | A | 4/2018 |
| CN | 107893074 | A | 4/2018 |
| CN | 107893075 | A | 4/2018 |
| CN | 107893076 | A | 4/2018 |
| CN | 107893080 | A | 4/2018 |
| CN | 107893086 | A | 4/2018 |
| CN | 107904261 | A | 4/2018 |
| CN | 107937427 | A | 4/2018 |
| CN | 107937432 | A | 4/2018 |
| CN | 107937501 | A | 4/2018 |
| CN | 107974466 | A | 5/2018 |
| CN | 107988229 | A | 5/2018 |
| CN | 107988246 | A | 5/2018 |
| CN | 107988256 | A | 5/2018 |
| CN | 107988268 | A | 5/2018 |
| CN | 108018316 | A | 5/2018 |
| CN | 108034656 | A | 5/2018 |
| CN | 108048466 | A | 5/2018 |
| CN | 108102940 | A | 6/2018 |
| CN | 108103090 | A | 6/2018 |
| CN | 108103092 | A | 6/2018 |
| CN | 108103098 | A | 6/2018 |
| CN | 108103586 | A | 6/2018 |
| CN | 108148835 | A | 6/2018 |
| CN | 108148837 | A | 6/2018 |
| CN | 108148873 | A | 6/2018 |
| CN | 108192956 | A | 6/2018 |
| CN | 108243575 | A | 7/2018 |
| CN | 108251423 | A | 7/2018 |
| CN | 108251451 | A | 7/2018 |
| CN | 108251452 | A | 7/2018 |
| CN | 108342480 | A | 7/2018 |
| CN | 108359691 | A | 8/2018 |
| CN | 108359712 | A | 8/2018 |
| CN | 108384784 | A | 8/2018 |
| CN | 108396027 | A | 8/2018 |
| CN | 108410877 | A | 8/2018 |
| CN | 108410906 | A | 8/2018 |
| CN | 108410907 | A | 8/2018 |
| CN | 108410911 | A | 8/2018 |
| CN | 108424931 | A | 8/2018 |
| CN | 108441519 | A | 8/2018 |
| CN | 108441520 | A | 8/2018 |
| CN | 108472314 | A | 8/2018 |
| CN | 108486108 | A | 9/2018 |
| CN | 108486111 | A | 9/2018 |
| CN | 108486145 | A | 9/2018 |
| CN | 108486146 | A | 9/2018 |
| CN | 108486154 | A | 9/2018 |
| CN | 108486159 | A | 9/2018 |
| CN | 108486234 | A | 9/2018 |
| CN | 108504657 | A | 9/2018 |
| CN | 108504685 | A | 9/2018 |
| CN | 108504693 | A | 9/2018 |
| CN | 108513575 | A | 9/2018 |
| CN | 108546712 | A | 9/2018 |
| CN | 108546717 | A | 9/2018 |
| CN | 108546718 | A | 9/2018 |
| CN | 108559730 | A | 9/2018 |
| CN | 108559732 | A | 9/2018 |
| CN | 108559745 | A | 9/2018 |
| CN | 108559760 | A | 9/2018 |
| CN | 108570479 | A | 9/2018 |
| CN | 108588071 | A | 9/2018 |
| CN | 108588123 | A | 9/2018 |
| CN | 108588128 | A | 9/2018 |
| CN | 108588182 | A | 9/2018 |
| CN | 108610399 | A | 10/2018 |
| CN | 108611364 | A | 10/2018 |
| CN | 108624622 | A | 10/2018 |
| CN | 108642053 | A | 10/2018 |
| CN | 108642055 | A | 10/2018 |
| CN | 108642077 | A | 10/2018 |
| CN | 108642078 | A | 10/2018 |
| CN | 108642090 | A | 10/2018 |
| CN | 108690844 | A | 10/2018 |
| CN | 108699542 | A | 10/2018 |
| CN | 108707604 | A | 10/2018 |
| CN | 108707620 | A | 10/2018 |
| CN | 108707621 | A | 10/2018 |
| CN | 108707628 | A | 10/2018 |
| CN | 108707629 | A | 10/2018 |
| CN | 108715850 | A | 10/2018 |
| CN | 108728476 | A | 11/2018 |
| CN | 108728486 | A | 11/2018 |
| CN | 108753772 | A | 11/2018 |

(56) References Cited

FOREIGN PATENT DOCUMENTS

| | | | |
|---|---|---|---|
| CN | 108753783 | A | 11/2018 |
| CN | 108753813 | A | 11/2018 |
| CN | 108753817 | A | 11/2018 |
| CN | 108753832 | A | 11/2018 |
| CN | 108753835 | A | 11/2018 |
| CN | 108753836 | A | 11/2018 |
| CN | 108795902 | A | 11/2018 |
| CN | 108822217 | A | 11/2018 |
| CN | 108823248 | A | 11/2018 |
| CN | 108823249 | A | 11/2018 |
| CN | 108823291 | A | 11/2018 |
| CN | 108841845 | A | 11/2018 |
| CN | 108853133 | A | 11/2018 |
| CN | 108866093 | A | 11/2018 |
| CN | 108893529 | A | 11/2018 |
| CN | 108913664 | A | 11/2018 |
| CN | 108913691 | A | 11/2018 |
| CN | 108913714 | A | 11/2018 |
| CN | 108913717 | A | 11/2018 |
| CN | 208034188 | U | 11/2018 |
| CN | 109504707 | A | 3/2019 |
| CN | 109517841 | A | 3/2019 |
| CN | 111471745 | A | 7/2020 |
| EP | 264166 | A1 | 4/1988 |
| EP | 0321201 | B2 | 6/1989 |
| EP | 0519463 | A1 | 12/1992 |
| EP | 1085892 | A2 | 3/2001 |
| EP | 1092770 | A2 | 4/2001 |
| EP | 2350295 | B1 | 5/2013 |
| EP | 2604255 | A1 | 6/2013 |
| EP | 2840140 | A1 | 2/2015 |
| EP | 2877490 | A2 | 6/2015 |
| EP | 2966170 | A1 | 1/2016 |
| EP | 3009511 | A2 | 4/2016 |
| EP | 3031921 | A1 | 6/2016 |
| EP | 3045537 | A1 | 7/2016 |
| EP | 3115457 | A1 | 1/2017 |
| EP | 3144390 | A1 | 3/2017 |
| EP | 2583974 | B1 | 4/2017 |
| EP | 3199632 | A1 | 8/2017 |
| EP | 3216867 | A1 | 9/2017 |
| EP | 3235828 | A1 | 10/2017 |
| EP | 3252160 | A1 | 12/2017 |
| EP | 2498823 | B1 | 8/2018 |
| EP | 3365437 | A1 | 8/2018 |
| EP | 3454889 | A2 | 3/2019 |
| EP | 3008192 | B1 | 7/2019 |
| EP | 3079725 | B1 | 10/2019 |
| EP | 3450553 | B1 | 12/2019 |
| EP | 3622079 | A1 | 3/2020 |
| EP | 3389700 | B1 | 11/2020 |
| EP | 3294756 | B1 | 12/2020 |
| EP | 3752623 | A1 | 12/2020 |
| EP | 2776567 | B1 | 1/2021 |
| EP | 3177726 | B1 | 1/2021 |
| EP | 3788155 | A1 | 3/2021 |
| EP | 3793570 | A2 | 3/2021 |
| EP | 3455239 | B1 | 4/2021 |
| EP | 3820995 | A1 | 5/2021 |
| EP | 3844272 | A1 | 7/2021 |
| EP | 3856898 | A1 | 8/2021 |
| EP | 3880717 | A1 | 9/2021 |
| EP | 3880831 | A1 | 9/2021 |
| EP | 4031561 | A1 | 7/2022 |
| ES | 2740248 | T3 | 2/2020 |
| GB | 2528177 | A | 1/2016 |
| GB | 2531454 | A1 | 4/2016 |
| GB | 2542653 | A | 3/2017 |
| HK | 1208045 | A1 | 2/2016 |
| JP | 2007-501626 | A | 2/2007 |
| JP | 2008-515405 | A | 5/2008 |
| JP | 2010-033344 | A | 2/2010 |
| JP | 2010-521978 | A | 7/2010 |
| JP | 2010-535744 | A | 11/2010 |
| JP | 2010-539929 | A | 12/2010 |
| JP | 2011-081011 | A | 4/2011 |
| JP | 2011-523353 | A | 8/2011 |
| JP | 2012-525146 | A | 10/2012 |
| JP | 2012-210172 | A | 11/2012 |
| JP | 2012-531909 | A | 12/2012 |
| JP | 2015-523856 | A | 8/2015 |
| JP | 2015-532654 | A | 11/2015 |
| JP | 2016-525888 | A | 9/2016 |
| JP | 2016-533760 | A | 11/2016 |
| JP | 2016-534132 | A | 11/2016 |
| JP | 2017-500035 | A | 1/2017 |
| JP | 2018-521045 | A | 8/2018 |
| JP | 2019-506123 | A | 2/2019 |
| JP | 6629734 | B2 | 1/2020 |
| JP | 6633524 | B2 | 1/2020 |
| JP | 6830517 | B2 | 2/2021 |
| JP | 2021-523739 | A | 9/2021 |
| JP | 7324523 | B2 | 8/2023 |
| KR | 101584933 | B1 | 1/2016 |
| KR | 2016-0050069 | A | 5/2016 |
| KR | 20160133380 | A | 11/2016 |
| KR | 20170037025 | A | 4/2017 |
| KR | 20170037028 | A | 4/2017 |
| KR | 101748575 | B1 | 6/2017 |
| KR | 20170128137 | A | 11/2017 |
| KR | 2018-0022465 | A | 3/2018 |
| RU | 2016104674 | A | 8/2017 |
| RU | 2634395 | C1 | 10/2017 |
| RU | 2652899 | C1 | 5/2018 |
| RU | 2015128057 | A | 3/2019 |
| RU | 2015128098 | A | 3/2019 |
| RU | 2687451 | C1 | 5/2019 |
| RU | 2019112514 | A | 6/2019 |
| RU | 2019127300 | A | 9/2019 |
| RU | 2701850 | C2 | 10/2019 |
| SG | 10201707569 | | 10/2017 |
| SG | 10201710486 | | 1/2018 |
| SG | 10201710487 | | 1/2018 |
| SG | 10201710488 | | 1/2018 |
| TW | I608100 | B | 12/2017 |
| TW | 201809272 | A | 3/2018 |
| TW | 2018-29773 | A | 8/2018 |
| WO | WO 1990/002809 | A1 | 3/1990 |
| WO | WO 1991/003162 | A1 | 3/1991 |
| WO | WO 1991/016024 | A1 | 10/1991 |
| WO | WO 1991/017271 | A1 | 11/1991 |
| WO | WO 1991/017424 | A1 | 11/1991 |
| WO | WO 1992/006188 | A2 | 4/1992 |
| WO | WO 1992/006200 | A1 | 4/1992 |
| WO | WO 1992/007065 | A1 | 4/1992 |
| WO | WO 1993/015187 | A1 | 8/1993 |
| WO | WO 1993/024641 | A2 | 12/1993 |
| WO | WO 1994/018316 | A2 | 8/1994 |
| WO | WO 1994/026877 | A1 | 11/1994 |
| WO | WO 1996/004403 | A1 | 2/1996 |
| WO | WO 1996/010640 | A1 | 4/1996 |
| WO | WO 1997/025416 | A2 | 7/1997 |
| WO | WO 1998/032845 | A1 | 7/1998 |
| WO | WO 1998/050538 | A1 | 11/1998 |
| WO | WO 2001/036452 | A2 | 5/2001 |
| WO | WO 2001/038547 | A2 | 5/2001 |
| WO | WO 2001/083692 | A2 | 11/2001 |
| WO | WO 2002/059296 | A2 | 8/2002 |
| WO | WO 2002/068676 | A2 | 9/2002 |
| WO | WO 2002/103028 | A2 | 12/2002 |
| WO | WO 2003/004608 | A2 | 1/2003 |
| WO | WO 2004/007684 | A2 | 1/2004 |
| WO | WO 2005/014791 | A2 | 2/2005 |
| WO | WO 2005/019415 | A2 | 3/2005 |
| WO | WO 2006/002547 | A1 | 1/2006 |
| WO | WO 2006/042112 | A2 | 4/2006 |
| WO | WO 2007/025097 | A2 | 3/2007 |
| WO | WO 2007/037444 | A1 | 4/2007 |
| WO | WO 2007/066923 | A1 | 6/2007 |
| WO | WO 2007/136815 | A2 | 11/2007 |
| WO | WO 2007/143574 | A1 | 12/2007 |
| WO | WO 2008/005529 | A2 | 1/2008 |
| WO | WO 2008/108989 | A2 | 9/2008 |
| WO | WO 2009/002418 | A2 | 12/2008 |

(56) References Cited

FOREIGN PATENT DOCUMENTS

| | | | |
|---|---|---|---|
| WO | WO 2009/019317 | A1 | 2/2009 |
| WO | WO 2009/098290 | A1 | 8/2009 |
| WO | WO 2009/134808 | A2 | 11/2009 |
| WO | WO 2010/011961 | A2 | 1/2010 |
| WO | WO 2010/012902 | A1 | 2/2010 |
| WO | WO 2010/028347 | A2 | 3/2010 |
| WO | WO 2010/054108 | A2 | 5/2010 |
| WO | WO 2010/054154 | A2 | 5/2010 |
| WO | WO 2010/068289 | A2 | 6/2010 |
| WO | WO 2010/075424 | A2 | 7/2010 |
| WO | WO 2010/091122 | A1 | 8/2010 |
| WO | WO 2010/102257 | A2 | 9/2010 |
| WO | WO 2010/104749 | A2 | 9/2010 |
| WO | WO 2010/129019 | A2 | 11/2010 |
| WO | WO 2010/129023 | A2 | 11/2010 |
| WO | WO 2010/132092 | A2 | 11/2010 |
| WO | WO 2010/144150 | A2 | 12/2010 |
| WO | WO 2011/002503 | A1 | 1/2011 |
| WO | WO 2011/017293 | A2 | 2/2011 |
| WO | WO 2011/053868 | A1 | 5/2011 |
| WO | WO 2011/053982 | A2 | 5/2011 |
| WO | WO 2011/068810 | A1 | 6/2011 |
| WO | WO 2011/075627 | A1 | 6/2011 |
| WO | WO 2011/091311 | A2 | 7/2011 |
| WO | WO 2011/091396 | A1 | 7/2011 |
| WO | WO 2011/109031 | A1 | 9/2011 |
| WO | WO 2011/143124 | A2 | 11/2011 |
| WO | WO 2011/147590 | A2 | 12/2011 |
| WO | WO 2011/159369 | A1 | 12/2011 |
| WO | WO 2012/054726 | A1 | 4/2012 |
| WO | WO 2012/061815 | A2 | 5/2012 |
| WO | WO 2012/065043 | A2 | 5/2012 |
| WO | WO 2012/088381 | A2 | 6/2012 |
| WO | WO 2012/125445 | A2 | 9/2012 |
| WO | WO 2012/138927 | A2 | 10/2012 |
| WO | WO 2012/149470 | A1 | 11/2012 |
| WO | WO 2012/158985 | A2 | 11/2012 |
| WO | WO 2012/158986 | A2 | 11/2012 |
| WO | WO 2012/164565 | A1 | 12/2012 |
| WO | WO 2012/170930 | A1 | 12/2012 |
| WO | WO 2013/012674 | A1 | 1/2013 |
| WO | WO 2013/013105 | A1 | 1/2013 |
| WO | WO 2013/039857 | A1 | 3/2013 |
| WO | WO 2013/039861 | A2 | 3/2013 |
| WO | WO 2013/040093 | A2 | 3/2013 |
| WO | WO 2013/045632 | A1 | 4/2013 |
| WO | WO 2013/047844 | A1 | 4/2013 |
| WO | WO 2013/066438 | A2 | 5/2013 |
| WO | WO 2013/086441 | A2 | 6/2013 |
| WO | WO 2013/086444 | A2 | 6/2013 |
| WO | WO 2013/098244 | A1 | 7/2013 |
| WO | WO 2013/119602 | A1 | 8/2013 |
| WO | WO 2013/120022 | A2 | 8/2013 |
| WO | WO 2013/122617 | A1 | 8/2013 |
| WO | WO 2013/126794 | A1 | 8/2013 |
| WO | WO 2013/130683 | A2 | 9/2013 |
| WO | WO 2013/130824 | A1 | 9/2013 |
| WO | WO 2013/141680 | A1 | 9/2013 |
| WO | WO 2013/142578 | A2 | 9/2013 |
| WO | WO 2013/152359 | A1 | 10/2013 |
| WO | WO 2013/160230 | A1 | 10/2013 |
| WO | WO 2013/166315 | A1 | 11/2013 |
| WO | WO 2013/169398 | A2 | 11/2013 |
| WO | WO 2013/169802 | A2 | 11/2013 |
| WO | WO 2013/176772 | A2 | 11/2013 |
| WO | WO 2013/176915 | A1 | 11/2013 |
| WO | WO 2013/176916 | A1 | 11/2013 |
| WO | WO 2013/181440 | A1 | 12/2013 |
| WO | WO 2013/186754 | A2 | 12/2013 |
| WO | WO 2013/188037 | A2 | 12/2013 |
| WO | WO 2013/188522 | A2 | 12/2013 |
| WO | WO 2013/188638 | A2 | 12/2013 |
| WO | WO 2013/192278 | A1 | 12/2013 |
| WO | WO 2013/142378 | A9 | 1/2014 |
| WO | WO 2014/004336 | A2 | 1/2014 |
| WO | WO 2014/005042 | A2 | 1/2014 |
| WO | WO 2014/011237 | A1 | 1/2014 |
| WO | WO 2014/011901 | A2 | 1/2014 |
| WO | WO 2014/018423 | A2 | 1/2014 |
| WO | WO 2014/020608 | A1 | 2/2014 |
| WO | WO 2014/022120 | A1 | 2/2014 |
| WO | WO 2014/022702 | A2 | 2/2014 |
| WO | WO 2014/036219 | A2 | 3/2014 |
| WO | WO 2014/039513 | A2 | 3/2014 |
| WO | WO 2014/039523 | A1 | 3/2014 |
| WO | WO 2014/039585 | A2 | 3/2014 |
| WO | WO 2014/039684 | A1 | 3/2014 |
| WO | WO 2014/039692 | A2 | 3/2014 |
| WO | WO 2014/039702 | A2 | 3/2014 |
| WO | WO 2014/039872 | A1 | 3/2014 |
| WO | WO 2014/039970 | A1 | 3/2014 |
| WO | WO 2014/041327 | A1 | 3/2014 |
| WO | WO 2014/043143 | A1 | 3/2014 |
| WO | WO 2014/047103 | A2 | 3/2014 |
| WO | WO 2014/055782 | A1 | 4/2014 |
| WO | WO 2014/059173 | A2 | 4/2014 |
| WO | WO 2014/059255 | A1 | 4/2014 |
| WO | WO 2014/065596 | A1 | 5/2014 |
| WO | WO 2014/066505 | A1 | 5/2014 |
| WO | WO 2014/068346 | A2 | 5/2014 |
| WO | WO 2014/070887 | A1 | 5/2014 |
| WO | WO 2014/071006 | A1 | 5/2014 |
| WO | WO 2014/071219 | A1 | 5/2014 |
| WO | WO 2014/071235 | A1 | 5/2014 |
| WO | WO 2014/072941 | A1 | 5/2014 |
| WO | WO 2014/081729 | A1 | 5/2014 |
| WO | WO 2014/081730 | A1 | 5/2014 |
| WO | WO 2014/081855 | A1 | 5/2014 |
| WO | WO 2014/082644 | A1 | 6/2014 |
| WO | WO 2014/085261 | A1 | 6/2014 |
| WO | WO 2014/085593 | A1 | 6/2014 |
| WO | WO 2014/085830 | A2 | 6/2014 |
| WO | WO 2014/089212 | A1 | 6/2014 |
| WO | WO 2014/089290 | A1 | 6/2014 |
| WO | WO 2014/089348 | A1 | 6/2014 |
| WO | WO 2014/089513 | A1 | 6/2014 |
| WO | WO 2014/089533 | A2 | 6/2014 |
| WO | WO 2014/089541 | A2 | 6/2014 |
| WO | WO 2014/093479 | A1 | 6/2014 |
| WO | WO 2014/093595 | A1 | 6/2014 |
| WO | WO 2014/093622 | A2 | 6/2014 |
| WO | WO 2014/093635 | A1 | 6/2014 |
| WO | WO 2014/093655 | A2 | 6/2014 |
| WO | WO 2014/093661 | A2 | 6/2014 |
| WO | WO 2014/093694 | A1 | 6/2014 |
| WO | WO 2014/093701 | A1 | 6/2014 |
| WO | WO 2014/093709 | A1 | 6/2014 |
| WO | WO 2014/093712 | A1 | 6/2014 |
| WO | WO 2014/093718 | A1 | 6/2014 |
| WO | WO 2014/093736 | A1 | 6/2014 |
| WO | WO 2014/093768 | A1 | 6/2014 |
| WO | WO 2014/093852 | A1 | 6/2014 |
| WO | WO 2014/096972 | A2 | 6/2014 |
| WO | WO 2014/099744 | A1 | 6/2014 |
| WO | WO 2014/099750 | A2 | 6/2014 |
| WO | WO 2014/104878 | A1 | 7/2014 |
| WO | WO 2014/110006 | A1 | 7/2014 |
| WO | WO 2014/110552 | A1 | 7/2014 |
| WO | WO 2014/113493 | A1 | 7/2014 |
| WO | WO 2014/123967 | A2 | 8/2014 |
| WO | WO 2014/124226 | A1 | 8/2014 |
| WO | WO 2014/125668 | A1 | 8/2014 |
| WO | WO 2014/127287 | A1 | 8/2014 |
| WO | WO 2014/128324 | A1 | 8/2014 |
| WO | WO 2014/128659 | A1 | 8/2014 |
| WO | WO 2014/130706 | A1 | 8/2014 |
| WO | WO 2014/130955 | A1 | 8/2014 |
| WO | WO 2014/131833 | A1 | 9/2014 |
| WO | WO 2014/138379 | A1 | 9/2014 |
| WO | WO 2014/143381 | A1 | 9/2014 |
| WO | WO 2014/144094 | A1 | 9/2014 |
| WO | WO 2014/144155 | A1 | 9/2014 |
| WO | WO 2014/144288 | A1 | 9/2014 |
| WO | WO 2014/144592 | A2 | 9/2014 |

(56) References Cited

FOREIGN PATENT DOCUMENTS

| | | | |
|---|---|---|---|
| WO | WO 2014/144761 | A2 | 9/2014 |
| WO | WO 2014/144951 | A1 | 9/2014 |
| WO | WO 2014/145599 | A2 | 9/2014 |
| WO | WO 2014/145736 | A2 | 9/2014 |
| WO | WO 2014/150624 | A1 | 9/2014 |
| WO | WO 2014/152432 | A2 | 9/2014 |
| WO | WO 2014/152940 | A1 | 9/2014 |
| WO | WO 2014/153118 | A1 | 9/2014 |
| WO | WO 2014/153470 | A2 | 9/2014 |
| WO | WO 2014/158593 | A1 | 10/2014 |
| WO | WO 2014/161821 | A1 | 10/2014 |
| WO | WO 2014/164466 | A1 | 10/2014 |
| WO | WO 2014/165177 | A1 | 10/2014 |
| WO | WO 2014/165349 | A1 | 10/2014 |
| WO | WO 2014/165612 | A2 | 10/2014 |
| WO | WO 2014/165707 | A2 | 10/2014 |
| WO | WO 2014/165825 | A2 | 10/2014 |
| WO | WO 2014/172458 | A1 | 10/2014 |
| WO | WO 2014/172470 | A2 | 10/2014 |
| WO | WO 2014/172489 | A2 | 10/2014 |
| WO | WO 2014/173955 | A1 | 10/2014 |
| WO | WO 2014/182700 | A1 | 11/2014 |
| WO | WO 2014/183071 | A2 | 11/2014 |
| WO | WO 2014/184143 | A1 | 11/2014 |
| WO | WO 2014/184741 | A1 | 11/2014 |
| WO | WO 2014/184744 | A1 | 11/2014 |
| WO | WO 2014/186585 | A2 | 11/2014 |
| WO | WO 2014/186686 | A2 | 11/2014 |
| WO | WO 2014/190181 | A1 | 11/2014 |
| WO | WO 2014/191128 | A1 | 12/2014 |
| WO | WO 2014/191518 | A1 | 12/2014 |
| WO | WO 2014/191521 | A2 | 12/2014 |
| WO | WO 2014/191525 | A1 | 12/2014 |
| WO | WO 2014/191527 | A1 | 12/2014 |
| WO | WO 2014/193583 | A2 | 12/2014 |
| WO | WO 2014/194190 | A1 | 12/2014 |
| WO | WO 2014/197568 | A2 | 12/2014 |
| WO | WO 2014/197748 | A2 | 12/2014 |
| WO | WO 2014/199358 | A1 | 12/2014 |
| WO | WO 2014/200659 | A1 | 12/2014 |
| WO | WO 2014/201015 | A2 | 12/2014 |
| WO | WO 2014/204578 | A1 | 12/2014 |
| WO | WO 2014/204723 | A1 | 12/2014 |
| WO | WO 2014/204724 | A1 | 12/2014 |
| WO | WO 2014/204725 | A1 | 12/2014 |
| WO | WO 2014/204726 | A1 | 12/2014 |
| WO | WO 2014/204727 | A1 | 12/2014 |
| WO | WO 2014/204728 | A1 | 12/2014 |
| WO | WO 2014/204729 | A1 | 12/2014 |
| WO | WO 2014/205192 | A2 | 12/2014 |
| WO | WO 2014/207043 | A1 | 12/2014 |
| WO | WO 2015/002780 | A1 | 1/2015 |
| WO | WO 2015/004241 | A2 | 1/2015 |
| WO | WO 2015/006290 | A1 | 1/2015 |
| WO | WO 2015/006294 | A2 | 1/2015 |
| WO | WO 2015/006437 | A1 | 1/2015 |
| WO | WO 2015/006498 | A2 | 1/2015 |
| WO | WO 2015/006747 | A2 | 1/2015 |
| WO | WO 2015/007194 | A1 | 1/2015 |
| WO | WO 2015/010114 | A1 | 1/2015 |
| WO | WO 2015/011483 | A1 | 1/2015 |
| WO | WO 2015/013583 | A2 | 1/2015 |
| WO | WO 2015/017866 | A1 | 2/2015 |
| WO | WO 2015/018503 | A1 | 2/2015 |
| WO | WO 2015/021353 | A1 | 2/2015 |
| WO | WO 2015/021426 | A1 | 2/2015 |
| WO | WO 2015/021990 | A1 | 2/2015 |
| WO | WO 2015/024017 | A2 | 2/2015 |
| WO | WO 2015/024986 | A1 | 2/2015 |
| WO | WO 2015/026883 | A1 | 2/2015 |
| WO | WO 2015/026885 | A1 | 2/2015 |
| WO | WO 2015/026886 | A1 | 2/2015 |
| WO | WO 2015/026887 | A1 | 2/2015 |
| WO | WO 2015/027134 | A1 | 2/2015 |
| WO | WO 2015/028969 | A2 | 3/2015 |
| WO | WO 2015/030881 | A1 | 3/2015 |
| WO | WO 2015/031619 | A1 | 3/2015 |
| WO | WO 2015/031775 | A1 | 3/2015 |
| WO | WO 2015/032494 | A2 | 3/2015 |
| WO | WO 2015/033293 | A1 | 3/2015 |
| WO | WO 2015/034872 | A2 | 3/2015 |
| WO | WO 2015/034885 | A1 | 3/2015 |
| WO | WO 2015/035136 | A2 | 3/2015 |
| WO | WO 2015/035139 | A2 | 3/2015 |
| WO | WO 2015/035162 | A2 | 3/2015 |
| WO | WO 2015/040075 | A1 | 3/2015 |
| WO | WO 2015/040402 | A1 | 3/2015 |
| WO | WO 2015/042393 | A2 | 3/2015 |
| WO | WO 2015/042585 | A1 | 3/2015 |
| WO | WO 2015/048577 | A2 | 4/2015 |
| WO | WO 2015/048690 | A1 | 4/2015 |
| WO | WO 2015/048707 | A2 | 4/2015 |
| WO | WO 2015/048801 | A2 | 4/2015 |
| WO | WO 2015/049897 | A1 | 4/2015 |
| WO | WO 2015/051191 | A1 | 4/2015 |
| WO | WO 2015/052133 | A1 | 4/2015 |
| WO | WO 2015/052231 | A2 | 4/2015 |
| WO | WO 2015/052335 | A1 | 4/2015 |
| WO | WO 2015/053995 | A1 | 4/2015 |
| WO | WO 2015/054253 | A1 | 4/2015 |
| WO | WO 2015/054315 | A1 | 4/2015 |
| WO | WO 2015/057671 | A1 | 4/2015 |
| WO | WO 2015/057834 | A1 | 4/2015 |
| WO | WO 2015/057852 | A1 | 4/2015 |
| WO | WO 2015/057976 | A1 | 4/2015 |
| WO | WO 2015/057980 | A1 | 4/2015 |
| WO | WO 2015/059265 | A1 | 4/2015 |
| WO | WO 2015/065964 | A1 | 5/2015 |
| WO | WO 2015/066119 | A1 | 5/2015 |
| WO | WO 2015/066634 | A2 | 5/2015 |
| WO | WO 2015/066636 | A2 | 5/2015 |
| WO | WO 2015/066637 | A1 | 5/2015 |
| WO | WO 2015/066638 | A2 | 5/2015 |
| WO | WO 2015/066643 | A1 | 5/2015 |
| WO | WO 2015/069682 | A2 | 5/2015 |
| WO | WO 2015/070083 | A1 | 5/2015 |
| WO | WO 2015/070193 | A1 | 5/2015 |
| WO | WO 2015/070212 | A1 | 5/2015 |
| WO | WO 2015/071474 | A2 | 5/2015 |
| WO | WO 2015/073683 | A2 | 5/2015 |
| WO | WO 2015/073867 | A1 | 5/2015 |
| WO | WO 2015/073990 | A1 | 5/2015 |
| WO | WO 2015/075056 | A1 | 5/2015 |
| WO | WO 2015/075154 | A2 | 5/2015 |
| WO | WO 2015/075175 | A1 | 5/2015 |
| WO | WO 2015/075195 | A1 | 5/2015 |
| WO | WO 2015/075557 | A2 | 5/2015 |
| WO | WO 2015/077058 | A2 | 5/2015 |
| WO | WO 2015/077290 | A2 | 5/2015 |
| WO | WO 2015/077318 | A1 | 5/2015 |
| WO | WO 2015/079056 | A1 | 6/2015 |
| WO | WO 2015/079057 | A2 | 6/2015 |
| WO | WO 2015/086795 | A1 | 6/2015 |
| WO | WO 2015/086798 | A2 | 6/2015 |
| WO | WO 2015/088643 | A1 | 6/2015 |
| WO | WO 2015/089046 | A1 | 6/2015 |
| WO | WO 2015/089077 | A2 | 6/2015 |
| WO | WO 2015/089277 | A1 | 6/2015 |
| WO | WO 2015/089351 | A1 | 6/2015 |
| WO | WO 2015/089354 | A1 | 6/2015 |
| WO | WO 2015/089364 | A1 | 6/2015 |
| WO | WO 2015/089406 | A1 | 6/2015 |
| WO | WO 2015/089419 | A2 | 6/2015 |
| WO | WO 2015/089427 | A1 | 6/2015 |
| WO | WO 2015/089462 | A1 | 6/2015 |
| WO | WO 2015/089465 | A1 | 6/2015 |
| WO | WO 2015/089473 | A1 | 6/2015 |
| WO | WO 2015/089486 | A2 | 6/2015 |
| WO | WO 2015/095804 | A1 | 6/2015 |
| WO | WO 2015/099850 | A1 | 7/2015 |
| WO | WO 2015/100929 | A1 | 7/2015 |
| WO | WO 2015/103057 | A1 | 7/2015 |
| WO | WO 2015/103153 | A1 | 7/2015 |
| WO | WO 2015/105928 | A1 | 7/2015 |

(56) References Cited

FOREIGN PATENT DOCUMENTS

| | | | |
|---|---|---|---|
| WO | WO 2015/108993 | A1 | 7/2015 |
| WO | WO 2015/109752 | A1 | 7/2015 |
| WO | WO 2015/110474 | A1 | 7/2015 |
| WO | WO 2015/112790 | A2 | 7/2015 |
| WO | WO 2015/112896 | A2 | 7/2015 |
| WO | WO 2015/113063 | A1 | 7/2015 |
| WO | WO 2015/114365 | A1 | 8/2015 |
| WO | WO 2015/115903 | A1 | 8/2015 |
| WO | WO 2015/116686 | A1 | 8/2015 |
| WO | WO 2015/116969 | A2 | 8/2015 |
| WO | WO 2015/117021 | A1 | 8/2015 |
| WO | WO 2015/117041 | A1 | 8/2015 |
| WO | WO 2015/117081 | A2 | 8/2015 |
| WO | WO 2015/118156 | A1 | 8/2015 |
| WO | WO 2015/119941 | A2 | 8/2015 |
| WO | WO 2015/121454 | A1 | 8/2015 |
| WO | WO 2015/122967 | A1 | 8/2015 |
| WO | WO 2015/123339 | A1 | 8/2015 |
| WO | WO 2015/124715 | A1 | 8/2015 |
| WO | WO 2015/124718 | A1 | 8/2015 |
| WO | WO 2015/126927 | A2 | 8/2015 |
| WO | WO 2015/127428 | A1 | 8/2015 |
| WO | WO 2015/127439 | A1 | 8/2015 |
| WO | WO 2015/129686 | A1 | 9/2015 |
| WO | WO 2015/131101 | A1 | 9/2015 |
| WO | WO 2015/133554 | A1 | 9/2015 |
| WO | WO 2015/134121 | A2 | 9/2015 |
| WO | WO 2015/134812 | A1 | 9/2015 |
| WO | WO 2015/136001 | A1 | 9/2015 |
| WO | WO 2015/138510 | A1 | 9/2015 |
| WO | WO 2015/138739 | A2 | 9/2015 |
| WO | WO 2015/138855 | A1 | 9/2015 |
| WO | WO 2015/138870 | A2 | 9/2015 |
| WO | WO 2015/139008 | A1 | 9/2015 |
| WO | WO 2015/139139 | A1 | 9/2015 |
| WO | WO 2015/143046 | A2 | 9/2015 |
| WO | WO 2015/143177 | A1 | 9/2015 |
| WO | WO 2015/145417 | A1 | 10/2015 |
| WO | WO 2015/148431 | A1 | 10/2015 |
| WO | WO 2015/148670 | A1 | 10/2015 |
| WO | WO 2015/148680 | A1 | 10/2015 |
| WO | WO 2015/148760 | A1 | 10/2015 |
| WO | WO 2015/148761 | A1 | 10/2015 |
| WO | WO 2015/148860 | A1 | 10/2015 |
| WO | WO 2015/148863 | A2 | 10/2015 |
| WO | WO 2015/153760 | A2 | 10/2015 |
| WO | WO 2015/153780 | A1 | 10/2015 |
| WO | WO 2015/153789 | A1 | 10/2015 |
| WO | WO 2015/153791 | A1 | 10/2015 |
| WO | WO 2015/153889 | A2 | 10/2015 |
| WO | WO 2015/153940 | A1 | 10/2015 |
| WO | WO 2015/155341 | A1 | 10/2015 |
| WO | WO 2015/155686 | A2 | 10/2015 |
| WO | WO 2015/157070 | A2 | 10/2015 |
| WO | WO 2015/157534 | A1 | 10/2015 |
| WO | WO 2015/159068 | A1 | 10/2015 |
| WO | WO 2015/159086 | A1 | 10/2015 |
| WO | WO 2015/159087 | A1 | 10/2015 |
| WO | WO 2015/160683 | A1 | 10/2015 |
| WO | WO 2015/161276 | A2 | 10/2015 |
| WO | WO 2015/163733 | A1 | 10/2015 |
| WO | WO 2015/164740 | A1 | 10/2015 |
| WO | WO 2015/164748 | A1 | 10/2015 |
| WO | WO 2015/165274 | A1 | 11/2015 |
| WO | WO 2015/165275 | A1 | 11/2015 |
| WO | WO 2015/165276 | A1 | 11/2015 |
| WO | WO 2015/166272 | A2 | 11/2015 |
| WO | WO 2015/167766 | A1 | 11/2015 |
| WO | WO 2015/167956 | A1 | 11/2015 |
| WO | WO 2015/168125 | A1 | 11/2015 |
| WO | WO 2015/168158 | A1 | 11/2015 |
| WO | WO 2015/168404 | A1 | 11/2015 |
| WO | WO 2015/168547 | A2 | 11/2015 |
| WO | WO 2015/168800 | A1 | 11/2015 |
| WO | WO 2015/171603 | A1 | 11/2015 |
| WO | WO 2015/171894 | A1 | 11/2015 |
| WO | WO 2015/171932 | A1 | 11/2015 |
| WO | WO 2015/172128 | A1 | 11/2015 |
| WO | WO 2015/173436 | A1 | 11/2015 |
| WO | WO 2015/175642 | A2 | 11/2015 |
| WO | WO 2015/179540 | A1 | 11/2015 |
| WO | WO 2015/183025 | A1 | 12/2015 |
| WO | WO 2015/183026 | A1 | 12/2015 |
| WO | WO 2015/183885 | A1 | 12/2015 |
| WO | WO 2015/184259 | A1 | 12/2015 |
| WO | WO 2015/184262 | A1 | 12/2015 |
| WO | WO 2015/184268 | A1 | 12/2015 |
| WO | WO 2015/188056 | A1 | 12/2015 |
| WO | WO 2015/188065 | A1 | 12/2015 |
| WO | WO 2015/188094 | A1 | 12/2015 |
| WO | WO 2015/188109 | A1 | 12/2015 |
| WO | WO 2015/188132 | A1 | 12/2015 |
| WO | WO 2015/188135 | A1 | 12/2015 |
| WO | WO 2015/188191 | A1 | 12/2015 |
| WO | WO 2015/189693 | A1 | 12/2015 |
| WO | WO 2015/191693 | A2 | 12/2015 |
| WO | WO 2015/191899 | A1 | 12/2015 |
| WO | WO 2015/191911 | A2 | 12/2015 |
| WO | WO 2015/193858 | A1 | 12/2015 |
| WO | WO 2015/195547 | A1 | 12/2015 |
| WO | WO 2015/195621 | A1 | 12/2015 |
| WO | WO 2015/195798 | A1 | 12/2015 |
| WO | WO 2015/198020 | A1 | 12/2015 |
| WO | WO 2015/200334 | A1 | 12/2015 |
| WO | WO 2015/200378 | A1 | 12/2015 |
| WO | WO 2015/200555 | A2 | 12/2015 |
| WO | WO 2015/200805 | A2 | 12/2015 |
| WO | WO 2016/001978 | A1 | 1/2016 |
| WO | WO 2016/004010 | A1 | 1/2016 |
| WO | WO 2016/004318 | A1 | 1/2016 |
| WO | WO 2016/005514 | A1 | 1/2016 |
| WO | WO 2016/007347 | A1 | 1/2016 |
| WO | WO 2016/007604 | A1 | 1/2016 |
| WO | WO 2016/007948 | A1 | 1/2016 |
| WO | WO 2016/011080 | A2 | 1/2016 |
| WO | WO 2016/011210 | A2 | 1/2016 |
| WO | WO 2016/011428 | A1 | 1/2016 |
| WO | WO 2016/012544 | A2 | 1/2016 |
| WO | WO 2016/012552 | A1 | 1/2016 |
| WO | WO 2016/014409 | A1 | 1/2016 |
| WO | WO 2016/014565 | A2 | 1/2016 |
| WO | WO 2016/014794 | A1 | 1/2016 |
| WO | WO 2016/014837 | A1 | 1/2016 |
| WO | WO 2016/016119 | A1 | 2/2016 |
| WO | WO 2016/016358 | A1 | 2/2016 |
| WO | WO 2016/019144 | A2 | 2/2016 |
| WO | WO 2016/020399 | A1 | 2/2016 |
| WO | WO 2016/021972 | A1 | 2/2016 |
| WO | WO 2016/021973 | A1 | 2/2016 |
| WO | WO 2016/022363 | A2 | 2/2016 |
| WO | WO 2016/022866 | A1 | 2/2016 |
| WO | WO 2016/022931 | A1 | 2/2016 |
| WO | WO 2016/025131 | A1 | 2/2016 |
| WO | WO 2016/025469 | A1 | 2/2016 |
| WO | WO 2016/025759 | A1 | 2/2016 |
| WO | WO 2016/026444 | A1 | 2/2016 |
| WO | WO 2016/028682 | A1 | 2/2016 |
| WO | WO 2016/028843 | A2 | 2/2016 |
| WO | WO 2016/028887 | A1 | 2/2016 |
| WO | WO 2016/033088 | A1 | 3/2016 |
| WO | WO 2016/033230 | A1 | 3/2016 |
| WO | WO 2016/033246 | A1 | 3/2016 |
| WO | WO 2016/033298 | A1 | 3/2016 |
| WO | WO 2016/035044 | A1 | 3/2016 |
| WO | WO 2016/035918 | A1 | 3/2016 |
| WO | WO 2016/036754 | A1 | 3/2016 |
| WO | WO 2016/037157 | A2 | 3/2016 |
| WO | WO 2016/040030 | A1 | 3/2016 |
| WO | WO 2016/040594 | A1 | 3/2016 |
| WO | WO 2016/044182 | A1 | 3/2016 |
| WO | WO 2016/044416 | A1 | 3/2016 |
| WO | WO 2016/046635 | A1 | 3/2016 |
| WO | WO 2016/049024 | A2 | 3/2016 |
| WO | WO 2016/049163 | A2 | 3/2016 |

(56) References Cited

FOREIGN PATENT DOCUMENTS

| | | | |
|---|---|---|---|
| WO | WO 2016/049230 | A1 | 3/2016 |
| WO | WO 2016/049251 | A1 | 3/2016 |
| WO | WO 2016/049258 | A2 | 3/2016 |
| WO | WO 2016/053397 | A2 | 4/2016 |
| WO | WO 2016/054326 | A1 | 4/2016 |
| WO | WO 2016/057061 | A2 | 4/2016 |
| WO | WO 2016/057821 | A2 | 4/2016 |
| WO | WO 2016/057835 | A2 | 4/2016 |
| WO | WO 2016/057850 | A1 | 4/2016 |
| WO | WO 2016/057951 | A2 | 4/2016 |
| WO | WO 2016/057961 | A1 | 4/2016 |
| WO | WO 2016/061073 | A1 | 4/2016 |
| WO | WO 2016/061374 | A1 | 4/2016 |
| WO | WO 2016/061481 | A1 | 4/2016 |
| WO | WO 2016/061523 | A1 | 4/2016 |
| WO | WO 2016/064894 | A2 | 4/2016 |
| WO | WO 2016/065364 | A1 | 4/2016 |
| WO | WO 2016/069282 | A1 | 5/2016 |
| WO | WO 2016/069283 | A1 | 5/2016 |
| WO | WO 2016/069591 | A2 | 5/2016 |
| WO | WO 2016/069774 | A1 | 5/2016 |
| WO | WO 2016/069910 | A1 | 5/2016 |
| WO | WO 2016/069912 | A1 | 5/2016 |
| WO | WO 2016/070037 | A2 | 5/2016 |
| WO | WO 2016/070070 | A1 | 5/2016 |
| WO | WO 2016/070129 | A1 | 5/2016 |
| WO | WO 2016/072399 | A1 | 5/2016 |
| WO | WO 2016/072936 | A1 | 5/2016 |
| WO | WO 2016/073433 | A1 | 5/2016 |
| WO | WO 2016/073559 | A1 | 5/2016 |
| WO | WO 2016/073990 | A2 | 5/2016 |
| WO | WO 2016/075662 | A2 | 5/2016 |
| WO | WO 2016/076672 | A1 | 5/2016 |
| WO | WO 2016/077273 | A1 | 5/2016 |
| WO | WO 2016/077350 | A1 | 5/2016 |
| WO | WO 2016/080097 | A1 | 5/2016 |
| WO | WO 2016/080795 | A1 | 5/2016 |
| WO | WO 2016/081923 | A2 | 5/2016 |
| WO | WO 2016/081924 | A1 | 5/2016 |
| WO | WO 2016/082135 | A1 | 6/2016 |
| WO | WO 2016/083811 | A1 | 6/2016 |
| WO | WO 2016/084084 | A1 | 6/2016 |
| WO | WO 2016/084088 | A1 | 6/2016 |
| WO | WO 2016/086177 | A2 | 6/2016 |
| WO | WO 2016/089433 | A1 | 6/2016 |
| WO | WO 2016/089866 | A1 | 6/2016 |
| WO | WO 2016/089883 | A1 | 6/2016 |
| WO | WO 2016/090385 | A1 | 6/2016 |
| WO | WO 2016/094679 | A1 | 6/2016 |
| WO | WO 2016/094845 | A2 | 6/2016 |
| WO | WO 2016/094867 | A1 | 6/2016 |
| WO | WO 2016/094872 | A1 | 6/2016 |
| WO | WO 2016/094874 | A1 | 6/2016 |
| WO | WO 2016/094880 | A1 | 6/2016 |
| WO | WO 2016/094888 | A1 | 6/2016 |
| WO | WO 2016/097212 | A1 | 6/2016 |
| WO | WO 2016/097231 | A2 | 6/2016 |
| WO | WO 2016/097751 | A1 | 6/2016 |
| WO | WO 2016/099887 | A1 | 6/2016 |
| WO | WO 2016/100272 | A1 | 6/2016 |
| WO | WO 2016/100389 | A1 | 6/2016 |
| WO | WO 2016/100568 | A1 | 6/2016 |
| WO | WO 2016/100571 | A1 | 6/2016 |
| WO | WO 2016/100951 | A2 | 6/2016 |
| WO | WO 2016/100955 | A2 | 6/2016 |
| WO | WO 2016/100974 | A1 | 6/2016 |
| WO | WO 2016/103233 | A2 | 6/2016 |
| WO | WO 2016/104716 | A1 | 6/2016 |
| WO | WO 2016/106236 | A1 | 6/2016 |
| WO | WO 2016/106239 | A1 | 6/2016 |
| WO | WO 2016/106244 | A1 | 6/2016 |
| WO | WO 2016/106338 | A2 | 6/2016 |
| WO | WO 2016/108926 | A1 | 7/2016 |
| WO | WO 2016/109255 | A1 | 7/2016 |
| WO | WO 2016/109840 | A2 | 7/2016 |
| WO | WO 2016/110214 | A1 | 7/2016 |
| WO | WO 2016/110453 | A1 | 7/2016 |
| WO | WO 2016/110511 | A1 | 7/2016 |
| WO | WO 2016/110512 | A1 | 7/2016 |
| WO | WO 2016/111546 | A2 | 7/2016 |
| WO | WO 2016/112242 | A1 | 7/2016 |
| WO | WO 2016/112351 | A1 | 7/2016 |
| WO | WO 2016/112963 | A1 | 7/2016 |
| WO | WO 2016/113357 | A1 | 7/2016 |
| WO | WO 2016/114972 | A1 | 7/2016 |
| WO | WO 2016/115179 | A1 | 7/2016 |
| WO | WO 2016/115326 | A1 | 7/2016 |
| WO | WO 2016/115355 | A1 | 7/2016 |
| WO | WO 2016/116032 | A1 | 7/2016 |
| WO | WO 2016/120480 | A1 | 8/2016 |
| WO | WO 2016/123071 | A1 | 8/2016 |
| WO | WO 2016/123230 | A1 | 8/2016 |
| WO | WO 2016/123243 | A1 | 8/2016 |
| WO | WO 2016/123578 | A1 | 8/2016 |
| WO | WO 2016/126747 | A1 | 8/2016 |
| WO | WO 2016/130600 | A2 | 8/2016 |
| WO | WO 2016/130697 | A1 | 8/2016 |
| WO | WO 2016/131009 | A1 | 8/2016 |
| WO | WO 2016/132122 | A1 | 8/2016 |
| WO | WO 2016/133165 | A1 | 8/2016 |
| WO | WO 2016/135507 | A1 | 9/2016 |
| WO | WO 2016/135557 | A2 | 9/2016 |
| WO | WO 2016/135558 | A2 | 9/2016 |
| WO | WO 2016/135559 | A2 | 9/2016 |
| WO | WO 2016/137774 | A1 | 9/2016 |
| WO | WO 2016/137949 | A1 | 9/2016 |
| WO | WO 2016/141224 | A1 | 9/2016 |
| WO | WO 2016/141893 | A1 | 9/2016 |
| WO | WO 2016/142719 | A1 | 9/2016 |
| WO | WO 2016/145150 | A2 | 9/2016 |
| WO | WO 2016/148994 | A1 | 9/2016 |
| WO | WO 2016/149484 | A2 | 9/2016 |
| WO | WO 2016/149547 | A1 | 9/2016 |
| WO | WO 2016/150336 | A1 | 9/2016 |
| WO | WO 2016/150855 | A1 | 9/2016 |
| WO | WO 2016/154016 | A2 | 9/2016 |
| WO | WO 2016/154579 | A2 | 9/2016 |
| WO | WO 2016/154596 | A1 | 9/2016 |
| WO | WO 2016/155482 | A1 | 10/2016 |
| WO | WO 2016/161004 | A1 | 10/2016 |
| WO | WO 2016/161207 | A1 | 10/2016 |
| WO | WO 2016/161260 | A1 | 10/2016 |
| WO | WO 2016/161380 | A1 | 10/2016 |
| WO | WO 2016/161446 | A1 | 10/2016 |
| WO | WO 2016/164305 | A1 | 10/2016 |
| WO | WO 2016/164356 | A1 | 10/2016 |
| WO | WO 2016/164797 | A1 | 10/2016 |
| WO | WO 2016/166340 | A1 | 10/2016 |
| WO | WO 2016/167300 | A1 | 10/2016 |
| WO | WO 2016/168631 | A1 | 10/2016 |
| WO | WO 2016/170484 | A1 | 10/2016 |
| WO | WO 2016/172359 | A2 | 10/2016 |
| WO | WO 2016/172727 | A1 | 10/2016 |
| WO | WO 2016/174056 | A1 | 11/2016 |
| WO | WO 2016/174151 | A1 | 11/2016 |
| WO | WO 2016/174250 | A1 | 11/2016 |
| WO | WO 2016/176191 | A1 | 11/2016 |
| WO | WO 2016/176404 | A1 | 11/2016 |
| WO | WO 2016/176690 | A2 | 11/2016 |
| WO | WO 2016/177682 | A1 | 11/2016 |
| WO | WO 2016/178207 | A1 | 11/2016 |
| WO | WO 2016/179038 | A1 | 11/2016 |
| WO | WO 2016/179112 | A1 | 11/2016 |
| WO | WO 2016/181357 | A1 | 11/2016 |
| WO | WO 2016/182893 | A1 | 11/2016 |
| WO | WO 2016/182917 | A1 | 11/2016 |
| WO | WO 2016/182959 | A1 | 11/2016 |
| WO | WO 2016/183236 | A1 | 11/2016 |
| WO | WO 2016/183298 | A2 | 11/2016 |
| WO | WO 2016/183345 | A1 | 11/2016 |
| WO | WO 2016/183402 | A2 | 11/2016 |
| WO | WO 2016/183438 | A1 | 11/2016 |
| WO | WO 2016/183448 | A1 | 11/2016 |
| WO | WO 2016/184955 | A2 | 11/2016 |

(56) References Cited

FOREIGN PATENT DOCUMENTS

| | | | |
|---|---|---|---|
| WO | WO 2016/184989 | A1 | 11/2016 |
| WO | WO 2016/185411 | A1 | 11/2016 |
| WO | WO 2016/186745 | A1 | 11/2016 |
| WO | WO 2016/186772 | A2 | 11/2016 |
| WO | WO 2016/186946 | A1 | 11/2016 |
| WO | WO 2016/186953 | A1 | 11/2016 |
| WO | WO 2016/187717 | A1 | 12/2016 |
| WO | WO 2016/187904 | A1 | 12/2016 |
| WO | WO 2016/191684 | A1 | 12/2016 |
| WO | WO 2016/191869 | A1 | 12/2016 |
| WO | WO 2016/196273 | A1 | 12/2016 |
| WO | WO 2016/196282 | A1 | 12/2016 |
| WO | WO 2016/196308 | A1 | 12/2016 |
| WO | WO 2016/196361 | A1 | 12/2016 |
| WO | WO 2016/196499 | A1 | 12/2016 |
| WO | WO 2016/196539 | A2 | 12/2016 |
| WO | WO 2016/196655 | A1 | 12/2016 |
| WO | WO 2016/196805 | A1 | 12/2016 |
| WO | WO 2016/196887 | A1 | 12/2016 |
| WO | WO 2016/197132 | A1 | 12/2016 |
| WO | WO 2016/197133 | A1 | 12/2016 |
| WO | WO 2016/197354 | A1 | 12/2016 |
| WO | WO 2016/197355 | A1 | 12/2016 |
| WO | WO 2016/197356 | A1 | 12/2016 |
| WO | WO 2016/197357 | A1 | 12/2016 |
| WO | WO 2016/197358 | A1 | 12/2016 |
| WO | WO 2016/197359 | A1 | 12/2016 |
| WO | WO 2016/197360 | A1 | 12/2016 |
| WO | WO 2016/197361 | A1 | 12/2016 |
| WO | WO 2016/197362 | A1 | 12/2016 |
| WO | WO 2016/198361 | A1 | 12/2016 |
| WO | WO 2016/198500 | A1 | 12/2016 |
| WO | WO 2016/200263 | A1 | 12/2016 |
| WO | WO 2016/201047 | A1 | 12/2016 |
| WO | WO 2016/201138 | A1 | 12/2016 |
| WO | WO 2016/201152 | A1 | 12/2016 |
| WO | WO 2016/201153 | A1 | 12/2016 |
| WO | WO 2016/201155 | A1 | 12/2016 |
| WO | WO 2016/205276 | A1 | 12/2016 |
| WO | WO 2016/205613 | A1 | 12/2016 |
| WO | WO 2016/205623 | A1 | 12/2016 |
| WO | WO 2016/205680 | A1 | 12/2016 |
| WO | WO 2016/205688 | A2 | 12/2016 |
| WO | WO 2016/205703 | A1 | 12/2016 |
| WO | WO 2016/205711 | A1 | 12/2016 |
| WO | WO 2016/205728 | A1 | 12/2016 |
| WO | WO 2016/205745 | A2 | 12/2016 |
| WO | WO 2016/205749 | A1 | 12/2016 |
| WO | WO 2016/205759 | A1 | 12/2016 |
| WO | WO 2016/205764 | A1 | 12/2016 |
| WO | WO 2017/001572 | A1 | 1/2017 |
| WO | WO 2017/001988 | A1 | 1/2017 |
| WO | WO 2017/004261 | A1 | 1/2017 |
| WO | WO 2017/004279 | A2 | 1/2017 |
| WO | WO 2017/004616 | A1 | 1/2017 |
| WO | WO 2017/005807 | A1 | 1/2017 |
| WO | WO 2017/009399 | A1 | 1/2017 |
| WO | WO 2017/010556 | A1 | 1/2017 |
| WO | WO 2017/011519 | A1 | 1/2017 |
| WO | WO 2017/011721 | A1 | 1/2017 |
| WO | WO 2017/011804 | A1 | 1/2017 |
| WO | WO 2017/015015 | A1 | 1/2017 |
| WO | WO 2017/015101 | A1 | 1/2017 |
| WO | WO 2017/015545 | A1 | 1/2017 |
| WO | WO 2017/015567 | A1 | 1/2017 |
| WO | WO 2017/015637 | A1 | 1/2017 |
| WO | WO 2017/017016 | A1 | 2/2017 |
| WO | WO 2017/019867 | A1 | 2/2017 |
| WO | WO 2017/019895 | A1 | 2/2017 |
| WO | WO 2017/023803 | A1 | 2/2017 |
| WO | WO 2017/023974 | A1 | 2/2017 |
| WO | WO 2017/024047 | A1 | 2/2017 |
| WO | WO 2017/024319 | A1 | 2/2017 |
| WO | WO 2017/024343 | A1 | 2/2017 |
| WO | WO 2017/024602 | A1 | 2/2017 |
| WO | WO 2017/025323 | A1 | 2/2017 |
| WO | WO 2017/027423 | A1 | 2/2017 |
| WO | WO 2017/028768 | A1 | 2/2017 |
| WO | WO 2017/029664 | A1 | 2/2017 |
| WO | WO 2017/031360 | A1 | 2/2017 |
| WO | WO 2017/031483 | A1 | 2/2017 |
| WO | WO 2017/035416 | A2 | 3/2017 |
| WO | WO 2017/040348 | A1 | 3/2017 |
| WO | WO 2017/040511 | A1 | 3/2017 |
| WO | WO 2017/040709 | A1 | 3/2017 |
| WO | WO 2017/040786 | A1 | 3/2017 |
| WO | WO 2017/040793 | A1 | 3/2017 |
| WO | WO 2017/040813 | A2 | 3/2017 |
| WO | WO 2017/043573 | A1 | 3/2017 |
| WO | WO 2017/043656 | A1 | 3/2017 |
| WO | WO 2017/044419 | A1 | 3/2017 |
| WO | WO 2017/044776 | A1 | 3/2017 |
| WO | WO 2017/044857 | A2 | 3/2017 |
| WO | WO 2017/048390 | A1 | 3/2017 |
| WO | WO 2017/049129 | A2 | 3/2017 |
| WO | WO 2017/050963 | A1 | 3/2017 |
| WO | WO 2017/053312 | A1 | 3/2017 |
| WO | WO 2017/053431 | A2 | 3/2017 |
| WO | WO 2017/053713 | A1 | 3/2017 |
| WO | WO 2017/053729 | A1 | 3/2017 |
| WO | WO 2017/053753 | A1 | 3/2017 |
| WO | WO 2017/053762 | A1 | 3/2017 |
| WO | WO 2017/053879 | A1 | 3/2017 |
| WO | WO 2017/054721 | A1 | 4/2017 |
| WO | WO 2017/058658 | A2 | 4/2017 |
| WO | WO 2017/059241 | A1 | 4/2017 |
| WO | WO 2017/062605 | A1 | 4/2017 |
| WO | WO 2017/062723 | A1 | 4/2017 |
| WO | WO 2017/062754 | A1 | 4/2017 |
| WO | WO 2017/062855 | A1 | 4/2017 |
| WO | WO 2017/062886 | A1 | 4/2017 |
| WO | WO 2017/062983 | A1 | 4/2017 |
| WO | WO 2017/064439 | A1 | 4/2017 |
| WO | WO 2017/064546 | A1 | 4/2017 |
| WO | WO 2017/064566 | A2 | 4/2017 |
| WO | WO 2017/066175 | A1 | 4/2017 |
| WO | WO 2017/066497 | A2 | 4/2017 |
| WO | WO 2017/066588 | A2 | 4/2017 |
| WO | WO 2017/066707 | A1 | 4/2017 |
| WO | WO 2017/066781 | A1 | 4/2017 |
| WO | WO 2017/068077 | A1 | 4/2017 |
| WO | WO 2017/068377 | A1 | 4/2017 |
| WO | WO 2017/069829 | A2 | 4/2017 |
| WO | WO 2017/070029 | A1 | 4/2017 |
| WO | WO 2017/070032 | A1 | 4/2017 |
| WO | WO 2017/070169 | A1 | 4/2017 |
| WO | WO 2017/070284 | A1 | 4/2017 |
| WO | WO 2017/070598 | A1 | 4/2017 |
| WO | WO 2017/070605 | A1 | 4/2017 |
| WO | WO 2017/070632 | A2 | 4/2017 |
| WO | WO 2017/070633 | A2 | 4/2017 |
| WO | WO 2017/072590 | A1 | 5/2017 |
| WO | WO 2017/074526 | A1 | 5/2017 |
| WO | WO 2017/074962 | A1 | 5/2017 |
| WO | WO 2017/075261 | A1 | 5/2017 |
| WO | WO 2017/075335 | A1 | 5/2017 |
| WO | WO 2017/075475 | A1 | 5/2017 |
| WO | WO 2017/077135 | A1 | 5/2017 |
| WO | WO 2017/077329 | A2 | 5/2017 |
| WO | WO 2017/078751 | A1 | 5/2017 |
| WO | WO 2017/079400 | A1 | 5/2017 |
| WO | WO 2017/079428 | A1 | 5/2017 |
| WO | WO 2017/079673 | A1 | 5/2017 |
| WO | WO 2017/079724 | A1 | 5/2017 |
| WO | WO 2017/081097 | A1 | 5/2017 |
| WO | WO 2017/081288 | A1 | 5/2017 |
| WO | WO 2017/083368 | A1 | 5/2017 |
| WO | WO 2017/083722 | A1 | 5/2017 |
| WO | WO 2017/083766 | A1 | 5/2017 |
| WO | WO 2017/087395 | A1 | 5/2017 |
| WO | WO 2017/090724 | A1 | 6/2017 |
| WO | WO 2017/091510 | A1 | 6/2017 |
| WO | WO 2017/091630 | A1 | 6/2017 |
| WO | WO 2017/092201 | A1 | 6/2017 |

(56) References Cited

FOREIGN PATENT DOCUMENTS

| | | | |
|---|---|---|---|
| WO | WO 2017/093370 | A1 | 6/2017 |
| WO | WO 2017/093969 | A1 | 6/2017 |
| WO | WO 2017/095111 | A1 | 6/2017 |
| WO | WO 2017/096041 | A1 | 6/2017 |
| WO | WO 2017/096237 | A1 | 6/2017 |
| WO | WO 2017/100158 | A1 | 6/2017 |
| WO | WO 2017/100431 | A2 | 6/2017 |
| WO | WO 2017/104404 | A1 | 6/2017 |
| WO | WO 2017/105251 | A1 | 6/2017 |
| WO | WO 2017/105350 | A1 | 6/2017 |
| WO | WO 2017/105991 | A1 | 6/2017 |
| WO | WO 2017/106414 | A1 | 6/2017 |
| WO | WO 2017/106528 | A2 | 6/2017 |
| WO | WO 2017/106537 | A2 | 6/2017 |
| WO | WO 2017/106569 | A1 | 6/2017 |
| WO | WO 2017/106616 | A1 | 6/2017 |
| WO | WO 2017/106657 | A1 | 6/2017 |
| WO | WO 2017/106767 | A1 | 6/2017 |
| WO | WO 2017/109134 | A1 | 6/2017 |
| WO | WO 2017/109757 | A1 | 6/2017 |
| WO | WO 2017/112620 | A1 | 6/2017 |
| WO | WO 2017/115268 | A1 | 7/2017 |
| WO | WO 2017/117395 | A1 | 7/2017 |
| WO | WO 2017/118598 | A1 | 7/2017 |
| WO | WO 2017/118720 | A1 | 7/2017 |
| WO | WO 2017/123609 | A1 | 7/2017 |
| WO | WO 2017/123910 | A1 | 7/2017 |
| WO | WO 2017/124086 | A1 | 7/2017 |
| WO | WO 2017/124100 | A1 | 7/2017 |
| WO | WO 2017/124652 | A1 | 7/2017 |
| WO | WO 2017/126987 | A1 | 7/2017 |
| WO | WO 2017/127807 | A1 | 7/2017 |
| WO | WO 2017/131237 | A1 | 8/2017 |
| WO | WO 2017/132112 | A1 | 8/2017 |
| WO | WO 2017/132580 | A2 | 8/2017 |
| WO | WO 2017/136520 | A1 | 8/2017 |
| WO | WO 2017/136629 | A1 | 8/2017 |
| WO | WO 2017/136794 | A1 | 8/2017 |
| WO | WO 2017/139264 | A1 | 8/2017 |
| WO | WO 2017/139505 | A2 | 8/2017 |
| WO | WO 2017/141173 | A2 | 8/2017 |
| WO | WO 2017/142835 | A1 | 8/2017 |
| WO | WO 2017/142923 | A1 | 8/2017 |
| WO | WO 2017/142999 | A2 | 8/2017 |
| WO | WO 2017/143042 | A2 | 8/2017 |
| WO | WO 2017/147056 | A1 | 8/2017 |
| WO | WO 2017/147278 | A1 | 8/2017 |
| WO | WO 2017/147432 | A1 | 8/2017 |
| WO | WO 2017/147446 | A1 | 8/2017 |
| WO | WO 2017/147555 | A1 | 8/2017 |
| WO | WO 2017/151444 | A1 | 9/2017 |
| WO | WO 2017/151719 | A1 | 9/2017 |
| WO | WO 2017/152015 | A1 | 9/2017 |
| WO | WO 2017/155717 | A1 | 9/2017 |
| WO | WO 2017/157422 | A1 | 9/2017 |
| WO | WO 2017/158153 | A1 | 9/2017 |
| WO | WO 2017/160689 | A1 | 9/2017 |
| WO | WO 2017/160752 | A1 | 9/2017 |
| WO | WO 2017/160890 | A1 | 9/2017 |
| WO | WO 2017/161068 | A1 | 9/2017 |
| WO | WO 2017/165741 | A1 | 9/2017 |
| WO | WO 2017/165826 | A1 | 9/2017 |
| WO | WO 2017/165862 | A1 | 9/2017 |
| WO | WO 2017/167712 | A1 | 10/2017 |
| WO | WO 2017/172644 | A2 | 10/2017 |
| WO | WO 2017/172645 | A2 | 10/2017 |
| WO | WO 2017/172860 | A1 | 10/2017 |
| WO | WO 2017/173004 | A1 | 10/2017 |
| WO | WO 2017/173054 | A1 | 10/2017 |
| WO | WO 2017/173092 | A1 | 10/2017 |
| WO | WO 2017/174329 | A1 | 10/2017 |
| WO | WO 2017/176529 | A1 | 10/2017 |
| WO | WO 2017/176806 | A1 | 10/2017 |
| WO | WO 2017/178590 | A1 | 10/2017 |
| WO | WO 2017/180694 | A1 | 10/2017 |
| WO | WO 2017/180711 | A1 | 10/2017 |
| WO | WO 2017/180915 | A2 | 10/2017 |
| WO | WO 2017/180926 | A1 | 10/2017 |
| WO | WO 2017/181107 | A2 | 10/2017 |
| WO | WO 2017/181735 | A2 | 10/2017 |
| WO | WO 2017/182468 | A1 | 10/2017 |
| WO | WO 2017/182585 | A1 | 10/2017 |
| WO | WO 2017/182607 | A1 | 10/2017 |
| WO | WO 2017/184334 | A1 | 10/2017 |
| WO | WO 2017/184768 | A1 | 10/2017 |
| WO | WO 2017/184786 | A1 | 10/2017 |
| WO | WO 2017/186550 | A1 | 11/2017 |
| WO | WO 2017/189308 | A1 | 11/2017 |
| WO | WO 2017/189336 | A1 | 11/2017 |
| WO | WO 2017/190041 | A1 | 11/2017 |
| WO | WO 2017/190257 | A1 | 11/2017 |
| WO | WO 2017/190664 | A1 | 11/2017 |
| WO | WO 2017/191210 | A1 | 11/2017 |
| WO | WO 2017/191274 | A2 | 11/2017 |
| WO | WO 2017/192172 | A1 | 11/2017 |
| WO | WO 2017/192512 | A2 | 11/2017 |
| WO | WO 2017/192544 | A1 | 11/2017 |
| WO | WO 2017/192573 | A1 | 11/2017 |
| WO | WO 2017/193029 | A2 | 11/2017 |
| WO | WO 2017/193053 | A1 | 11/2017 |
| WO | WO 2017/196768 | A1 | 11/2017 |
| WO | WO 2017/197038 | A1 | 11/2017 |
| WO | WO 2017/197238 | A1 | 11/2017 |
| WO | WO 2017/197301 | A1 | 11/2017 |
| WO | WO 2017/201476 | A1 | 11/2017 |
| WO | WO 2017/205290 | A1 | 11/2017 |
| WO | WO 2017/205423 | A1 | 11/2017 |
| WO | WO 2017/207589 | A1 | 12/2017 |
| WO | WO 2017/208247 | A1 | 12/2017 |
| WO | WO 2017/209809 | A1 | 12/2017 |
| WO | WO 2017/213896 | A1 | 12/2017 |
| WO | WO 2017/213898 | A2 | 12/2017 |
| WO | WO 2017/214460 | A1 | 12/2017 |
| WO | WO 2017/216392 | A1 | 12/2017 |
| WO | WO 2017/216771 | A2 | 12/2017 |
| WO | WO 2017/218185 | A1 | 12/2017 |
| WO | WO 2017/219027 | A1 | 12/2017 |
| WO | WO 2017/219033 | A1 | 12/2017 |
| WO | WO 2017/220751 | A1 | 12/2017 |
| WO | WO 2017/222370 | A1 | 12/2017 |
| WO | WO 2017/222773 | A1 | 12/2017 |
| WO | WO 2017/222834 | A1 | 12/2017 |
| WO | WO 2017/223107 | A1 | 12/2017 |
| WO | WO 2017/223330 | A1 | 12/2017 |
| WO | WO 2018/000657 | A1 | 1/2018 |
| WO | WO 2018/00693 | A1 | 1/2018 |
| WO | WO 2018/002719 | A1 | 1/2018 |
| WO | WO 2018/005117 | A1 | 1/2018 |
| WO | WO 2018/005289 | A2 | 1/2018 |
| WO | WO 2018/005691 | A1 | 1/2018 |
| WO | WO 2018/005782 | A1 | 1/2018 |
| WO | WO 2018/005873 | A1 | 1/2018 |
| WO | WO 2018/009520 | A1 | 1/2018 |
| WO | WO 2018/009562 | A1 | 1/2018 |
| WO | WO 2018/009822 | A1 | 1/2018 |
| WO | WO 2018/013821 | A1 | 1/2018 |
| WO | WO 2018/013932 | A1 | 1/2018 |
| WO | WO 2018/013990 | A1 | 1/2018 |
| WO | WO 2018/014384 | A1 | 1/2018 |
| WO | WO 2018/015444 | A1 | 1/2018 |
| WO | WO 2018/015936 | A2 | 1/2018 |
| WO | WO 2018/017754 | A1 | 1/2018 |
| WO | WO 2018/018979 | A1 | 2/2018 |
| WO | WO 2018/020248 | A1 | 2/2018 |
| WO | WO 2018/021878 | A1 | 2/2018 |
| WO | WO 2018/022480 | A1 | 2/2018 |
| WO | WO 2018/022634 | A1 | 2/2018 |
| WO | WO 2018/025206 | A1 | 2/2018 |
| WO | WO 2018/026723 | A1 | 2/2018 |
| WO | WO 2018/026976 | A1 | 2/2018 |
| WO | WO 2018/027078 | A1 | 2/2018 |
| WO | WO 2018/030608 | A1 | 2/2018 |
| WO | WO 2018/031683 | A1 | 2/2018 |
| WO | WO 2018/035250 | A1 | 2/2018 |

(56) References Cited

FOREIGN PATENT DOCUMENTS

| | | | |
|---|---|---|---|
| WO | WO 2018/035300 | A1 | 2/2018 |
| WO | WO 2018/035423 | A1 | 2/2018 |
| WO | WO 2018/035503 | A1 | 2/2018 |
| WO | WO 2018/039145 | A1 | 3/2018 |
| WO | WO 2018/039438 | A1 | 3/2018 |
| WO | WO 2018/039440 | A1 | 3/2018 |
| WO | WO 2018/039448 | A1 | 3/2018 |
| WO | WO 2018/045630 | A1 | 3/2018 |
| WO | WO 2018/048827 | A1 | 3/2018 |
| WO | WO 2018/049073 | A1 | 3/2018 |
| WO | WO 2018/049168 | A1 | 3/2018 |
| WO | WO 2018/051347 | A1 | 3/2018 |
| WO | WO 2018/058064 | A1 | 3/2018 |
| WO | WO 2018/062866 | A2 | 4/2018 |
| WO | WO 2018/064352 | A1 | 4/2018 |
| WO | WO 2018/064371 | A1 | 4/2018 |
| WO | WO 2018/064516 | A1 | 4/2018 |
| WO | WO 2018/067546 | A1 | 4/2018 |
| WO | WO 2018/067846 | A1 | 4/2018 |
| WO | WO 2018/068053 | A2 | 4/2018 |
| WO | WO 2018/069474 | A1 | 4/2018 |
| WO | WO 2018/071623 | A2 | 4/2018 |
| WO | WO 2018/071663 | A1 | 4/2018 |
| WO | WO 2018/071868 | A1 | 4/2018 |
| WO | WO 2018/071892 | A1 | 4/2018 |
| WO | WO 2018/074979 | A1 | 4/2018 |
| WO | WO 2018/079134 | A1 | 5/2018 |
| WO | WO 2018/080573 | A1 | 5/2018 |
| WO | WO 2018/081504 | A1 | 5/2018 |
| WO | WO 2018/081535 | A2 | 5/2018 |
| WO | WO 2018/081728 | A1 | 5/2018 |
| WO | WO 2018/083128 | A2 | 5/2018 |
| WO | WO 2018/083606 | A1 | 5/2018 |
| WO | WO 2018/085288 | A1 | 5/2018 |
| WO | WO 2018/085414 | A1 | 5/2018 |
| WO | WO 2018/085842 | A1 | 5/2018 |
| WO | WO 2018/086623 | A1 | 5/2018 |
| WO | WO 2018/089664 | A1 | 5/2018 |
| WO | WO 2018/093990 | A1 | 5/2018 |
| WO | WO 2018/098383 | A1 | 5/2018 |
| WO | WO 2018/098480 | A1 | 5/2018 |
| WO | WO 2018/098587 | A1 | 6/2018 |
| WO | WO 2018/099256 | A1 | 6/2018 |
| WO | WO 2018/103686 | A1 | 6/2018 |
| WO | WO 2018/106268 | A1 | 6/2018 |
| WO | WO 2018/107028 | A1 | 6/2018 |
| WO | WO 2018/107103 | A1 | 6/2018 |
| WO | WO 2018/107129 | A1 | 6/2018 |
| WO | WO 2018/108272 | A1 | 6/2018 |
| WO | WO 2018/109101 | A1 | 6/2018 |
| WO | WO 2018/111946 | A1 | 6/2018 |
| WO | WO 2018/111947 | A1 | 6/2018 |
| WO | WO 2018/112336 | A1 | 6/2018 |
| WO | WO 2018/112446 | A2 | 6/2018 |
| WO | WO 2018/119354 | A1 | 6/2018 |
| WO | WO 2018/119359 | A1 | 6/2018 |
| WO | WO 2018/120283 | A1 | 7/2018 |
| WO | WO 2018/130830 | A1 | 7/2018 |
| WO | WO 2018/135838 | A2 | 7/2018 |
| WO | WO 2018/136396 | A2 | 7/2018 |
| WO | WO 2018/138385 | A1 | 8/2018 |
| WO | WO 2018/142364 | A1 | 8/2018 |
| WO | WO 2018/148246 | A1 | 8/2018 |
| WO | WO 2018/148256 | A1 | 8/2018 |
| WO | WO 2018/148647 | A2 | 8/2018 |
| WO | WO 2018/149418 | A1 | 8/2018 |
| WO | WO 2018/149888 | A1 | 8/2018 |
| WO | WO 2018/149915 | A1 | 8/2018 |
| WO | WO 2018/152197 | A1 | 8/2018 |
| WO | WO 2018/152418 | A1 | 8/2018 |
| WO | WO 2018/154380 | A1 | 8/2018 |
| WO | WO 2018/154387 | A1 | 8/2018 |
| WO | WO 2018/154412 | A1 | 8/2018 |
| WO | WO 2018/154413 | A1 | 8/2018 |
| WO | WO 2018/154418 | A1 | 8/2018 |
| WO | WO 2018/154439 | A1 | 8/2018 |
| WO | WO 2018/154459 | A1 | 8/2018 |
| WO | WO 2018/154462 | A2 | 8/2018 |
| WO | WO 2018/156372 | A1 | 8/2018 |
| WO | WO 2018/156824 | A1 | 8/2018 |
| WO | WO 2018/161009 | A1 | 9/2018 |
| WO | WO 2018/161032 | A1 | 9/2018 |
| WO | WO 2018/165504 | A1 | 9/2018 |
| WO | WO 2018/165629 | A1 | 9/2018 |
| WO | WO 2018/170015 | A1 | 9/2018 |
| WO | WO 2018/170340 | A1 | 9/2018 |
| WO | WO 2018/175502 | A2 | 9/2018 |
| WO | WO 2018/176009 | A1 | 9/2018 |
| WO | WO 2018/177351 | A1 | 10/2018 |
| WO | WO 2018/179578 | A1 | 10/2018 |
| WO | WO 2018/183403 | A1 | 10/2018 |
| WO | WO 2018/189184 | A1 | 10/2018 |
| WO | WO 2018/191388 | A1 | 10/2018 |
| WO | WO 2018/195402 | A1 | 10/2018 |
| WO | WO 2018/195545 | A2 | 10/2018 |
| WO | WO 2018/195555 | A1 | 10/2018 |
| WO | WO 2018/197020 | A1 | 11/2018 |
| WO | WO 2018/197495 | A1 | 11/2018 |
| WO | WO 2018/200597 | A1 | 11/2018 |
| WO | WO 2018/202800 | A1 | 11/2018 |
| WO | WO 2018/204493 | A1 | 11/2018 |
| WO | WO 2018/208755 | A1 | 11/2018 |
| WO | WO 2018/208998 | A1 | 11/2018 |
| WO | WO 2018/209158 | A2 | 11/2018 |
| WO | WO 2018/209320 | A1 | 11/2018 |
| WO | WO 2018/213351 | A1 | 11/2018 |
| WO | WO 2018/213708 | A1 | 11/2018 |
| WO | WO 2018/213726 | A1 | 11/2018 |
| WO | WO 2018/213771 | A1 | 11/2018 |
| WO | WO 2018/213791 | A1 | 11/2018 |
| WO | WO 2018/217852 | A1 | 11/2018 |
| WO | WO 2018/217981 | A1 | 11/2018 |
| WO | WO 2018/218166 | A1 | 11/2018 |
| WO | WO 2018/218188 | A2 | 11/2018 |
| WO | WO 2018/218206 | A1 | 11/2018 |
| WO | WO 2018/226855 | A1 | 12/2018 |
| WO | WO 2019/005884 | A1 | 1/2019 |
| WO | WO 2019/005886 | A1 | 1/2019 |
| WO | WO 2019/010384 | A1 | 1/2019 |
| WO | WO 2019/023680 | A1 | 1/2019 |
| WO | WO 2019/042284 | A1 | 3/2019 |
| WO | WO 2019/051097 | A1 | 3/2019 |
| WO | WO 2019/067992 | A1 | 4/2019 |
| WO | WO 2019/075357 | A1 | 4/2019 |
| WO | WO 2019/079347 | A1 | 4/2019 |
| WO | WO 2019/084062 | A1 | 5/2019 |
| WO | WO 2019/090169 | A1 | 5/2019 |
| WO | WO 2019/090367 | A1 | 5/2019 |
| WO | WO 2019/092042 | A1 | 5/2019 |
| WO | WO 2019/118497 | A1 | 6/2019 |
| WO | WO 2019/118935 | A1 | 6/2019 |
| WO | WO 2019/118949 | A1 | 6/2019 |
| WO | WO 2019/123429 | A1 | 6/2019 |
| WO | WO 2019/123430 | A1 | 6/2019 |
| WO | WO 2019/126709 | A1 | 6/2019 |
| WO | WO 2019/139645 | A2 | 7/2019 |
| WO | WO 2019/139951 | A1 | 7/2019 |
| WO | WO 2019/147014 | A1 | 8/2019 |
| WO | WO 2019/161251 | A1 | 8/2019 |
| WO | WO 2019/168953 | A1 | 9/2019 |
| WO | WO 2019/183641 | A1 | 9/2019 |
| WO | WO 2019/204369 | A1 | 10/2019 |
| WO | WO 2019/213257 | A1 | 11/2019 |
| WO | WO 2019/217942 | A1 | 11/2019 |
| WO | WO 2019/217943 | A1 | 11/2019 |
| WO | WO 2019/226593 | A1 | 11/2019 |
| WO | WO 2019/226953 | A1 | 11/2019 |
| WO | WO 2019/236566 | A1 | 12/2019 |
| WO | WO 2019/241649 | A1 | 12/2019 |
| WO | WO 2020/014261 | A1 | 1/2020 |
| WO | WO 2020/028555 | A2 | 2/2020 |
| WO | WO 2020/028823 | A1 | 2/2020 |
| WO | WO 2020/041751 | A1 | 2/2020 |
| WO | WO 2020/047124 | A1 | 3/2020 |

(56) References Cited

FOREIGN PATENT DOCUMENTS

| | | | |
|---|---|---|---|
| WO | WO 2020/051360 | A1 | 3/2020 |
| WO | WO 2020/081568 | A1 | 4/2020 |
| WO | WO 2020/086908 | A1 | 4/2020 |
| WO | WO 2020/092453 | A1 | 5/2020 |
| WO | WO 2020/102369 | A1 | 5/2020 |
| WO | WO 2020/102659 | A1 | 5/2020 |
| WO | WO 2020/102709 | A1 | 5/2020 |
| WO | WO 2020/154500 | A1 | 7/2020 |
| WO | WO 2020/157008 | A1 | 8/2020 |
| WO | WO 2020/160071 | A1 | 8/2020 |
| WO | WO 2020/160418 | A1 | 8/2020 |
| WO | WO 2020/160481 | A1 | 8/2020 |
| WO | WO 2020/160517 | A1 | 8/2020 |
| WO | WO 2020/180975 | A1 | 9/2020 |
| WO | WO 2020/181178 | A1 | 9/2020 |
| WO | WO 2020/181180 | A1 | 9/2020 |
| WO | WO 2020/181193 | A1 | 9/2020 |
| WO | WO 2020/181195 | A1 | 9/2020 |
| WO | WO 2020/181202 | A1 | 9/2020 |
| WO | WO 2020/191153 | A2 | 9/2020 |
| WO | WO 2020/191171 | A1 | 9/2020 |
| WO | WO 2020/191233 | A1 | 9/2020 |
| WO | WO 2020/191234 | A1 | 9/2020 |
| WO | WO 2020/191239 | A1 | 9/2020 |
| WO | WO 2020/191241 | A1 | 9/2020 |
| WO | WO 2020/191242 | A1 | 9/2020 |
| WO | WO 2020/191243 | A1 | 9/2020 |
| WO | WO 2020/191245 | A1 | 9/2020 |
| WO | WO 2020/191246 | A1 | 9/2020 |
| WO | WO 2020/191248 | A1 | 9/2020 |
| WO | WO 2020/191249 | A1 | 9/2020 |
| WO | WO 2020/193696 | A1 | 10/2020 |
| WO | WO 2020/205681 | A1 | 10/2020 |
| WO | WO 2020/210751 | A1 | 10/2020 |
| WO | WO 2020/214842 | A1 | 10/2020 |
| WO | WO 2020/225287 | A1 | 11/2020 |
| WO | WO 2020/236982 | A1 | 11/2020 |
| WO | WO 2020/247587 | A1 | 12/2020 |
| WO | WO 2020/247803 | A2 | 12/2020 |
| WO | WO 2021/022043 | A2 | 2/2021 |
| WO | WO 2021/025750 | A1 | 2/2021 |
| WO | WO 2021/030344 | A1 | 2/2021 |
| WO | WO 2021/030666 | A1 | 2/2021 |
| WO | WO 2021/042047 | A1 | 3/2021 |
| WO | WO 2021/042062 | A2 | 3/2021 |
| WO | WO 2021/046143 | A1 | 3/2021 |
| WO | WO 2021/072328 | A1 | 4/2021 |
| WO | WO 2021/080922 | A1 | 4/2021 |
| WO | WO 2021/081264 | A1 | 4/2021 |
| WO | WO 2021/087182 | A1 | 5/2021 |
| WO | WO 2021/087401 | A1 | 5/2021 |
| WO | WO 2021/108717 | A2 | 6/2021 |
| WO | WO 2021/113772 | A1 | 6/2021 |
| WO | WO 2021/138469 | A1 | 7/2021 |
| WO | WO 2021/142343 | A1 | 7/2021 |
| WO | WO 2021/155065 | A1 | 8/2021 |
| WO | WO 2021/158921 | A2 | 8/2021 |
| WO | WO 2021/158995 | A1 | 8/2021 |
| WO | WO 2021/158999 | A1 | 8/2021 |
| WO | WO 2021/178709 | A1 | 9/2021 |
| WO | WO 2021/178717 | A2 | 9/2021 |
| WO | WO 2021/178720 | A2 | 9/2021 |
| WO | WO 2021/178898 | A1 | 9/2021 |
| WO | WO 2021/183761 | A1 | 9/2021 |
| WO | WO 2021/183961 | A1 | 9/2021 |
| WO | WO 2021/188996 | A1 | 9/2021 |
| WO | WO 2021/220020 | A1 | 11/2021 |
| WO | WO 2021/222318 | A1 | 11/2021 |
| WO | WO 2021/226558 | A1 | 11/2021 |
| WO | WO 2021/231505 | A1 | 11/2021 |
| WO | WO 2021/233975 | A1 | 11/2021 |
| WO | WO 2021/252924 | A1 | 12/2021 |
| WO | WO 2022/008510 | A2 | 1/2022 |
| WO | WO 2022/013872 | A1 | 1/2022 |
| WO | WO 2022/051250 | A1 | 3/2022 |
| WO | WO 2022/056254 | A2 | 3/2022 |
| WO | WO 2022/067130 | A2 | 3/2022 |
| WO | WO 2022/075813 | A1 | 4/2022 |
| WO | WO 2022/075816 | A1 | 4/2022 |
| WO | WO 2022/092317 | A1 | 5/2022 |
| WO | WO 2022/150790 | A2 | 7/2022 |
| WO | WO 2022/165262 | A1 | 8/2022 |
| WO | WO 2023/015309 | A2 | 2/2023 |
| WO | WO 2023/102537 | A2 | 6/2023 |
| WO | WO 2023/102538 | A1 | 6/2023 |
| WO | WO 2023/102550 | A2 | 6/2023 |
| WO | WO 2023/173140 | A2 | 9/2023 |
| WO | WO 2024/155741 | A1 | 7/2024 |
| WO | WO 2024/155745 | A1 | 7/2024 |
| WO | WO 2024/215652 | A2 | 10/2024 |
| WO | WO 2024/254346 | A1 | 12/2024 |

OTHER PUBLICATIONS

Adikusuma, Fatwa, et al. "Versatile single-step-assembly CRISPR/Cas9 vectors for dual grna expression." Plos One, vol. 12, No. 12, Dec. 6, 2017, https://doi.org/10.1371/journal.pone.0187236. (Year: 2017).*

Cui Zhang, Renfu Quan, Jinfu Wang, Development and application of CRISPR/Cas9 technologies in genomic editing, Human Molecular Genetics, vol. 27, Issue R2, Aug. 1, 2018, pp. R79-R88, https://doi.org/10.1093/hmg/ddy120 (Year: 2018).*

Deneault, E. (2024). Recent Therapeutic Gene Editing Applications to Genetic Disorders. Current Issues in Molecular Biology, 46(5), 4147-4185. https://doi.org/10.3390/cimb46050255 (Year: 2024).*

Schmelas, C. and Grimm, D. (2018), Split Cas9, Not Hairs—Advancing the Therapeutic Index of CRISPR Technology. Biotechnol. J., 13: 1700432. https://doi.org/10.1002/biot.201700432 (Year: 2018).*

U.S. Appl. No. 17/289,665, filed Apr. 28, 2021, Liu et al.

U.S. Appl. No. 16/756,432, filed Apr. 15, 2020, Liu et al.

U.S. Appl. No. 16/772,747, filed Jun. 12, 2020, Shen et al.

U.S. Appl. No. 17/425,261, filed Jul. 22, 2021, Kim et al.

U.S. Appl. No. 17/057,398, filed Nov. 20, 2020, Liu et al.

U.S. Appl. No. 17/259,147, filed Jan. 8, 2021, Liu et al.

U.S. Appl. No. 17/270,396, filed Feb. 22, 2021, Liu et al.

U.S. Appl. No. 17/273,688, filed Mar. 4, 2021, Liu et al.

U.S. Appl. No. 17/294,287, filed May 14, 2021, Liu et al.

U.S. Appl. No. 17/288,504, filed Apr. 23, 2021, Liu et al.

U.S. Appl. No. 17/633,573, filed Feb. 7, 2022, Liu et al.

U.S. Appl. No. 17/436,048, filed Sep. 2, 2021, Liu et al.

U.S. Appl. No. 17/219,590, filed Mar. 31, 2021, Liu et al.

U.S. Appl. No. 17/603,917, filed Oct. 14, 2021, Liu et al.

U.S. Appl. No. 17/602,738, filed Oct. 8, 2021, Liu et al.

U.S. Appl. No. 17/300,668, filed Sep. 17, 2021, Liu et al.

U.S. Appl. No. 17/219,635, filed Mar. 31, 2021, Liu et al.

U.S. Appl. No. 17/219,672, filed Mar. 31, 2021, Liu et al.

U.S. Appl. No. 17/440,682, filed Sep. 17, 2021, Liu et al.

U.S. Appl. No. 14/234,031, filed Mar. 24, 2014, Liu et al.

U.S. Appl. No. 14/320,271, filed Jun. 30, 2014, Liu et al.

U.S. Appl. No. 16/441,751, filed Jun. 14, 2019, Liu et al.

U.S. Appl. No. 14/320,519, filed Jun. 30, 2014, Liu et al.

U.S. Appl. No. 14/913,458, filed Feb. 22, 2016, Liu et al.

U.S. Appl. No. 16/266,937, filed Feb. 4, 2019, Liu et al.

U.S. Appl. No. 14/320,370, filed Jun. 30, 2014, Liu et al.

U.S. Appl. No. 14/320,413, filed Jun. 30, 2014, Liu et al.

U.S. Appl. No. 14/874,123, filed Oct. 2, 2015, Liu et al.

U.S. Appl. No. 14/911,117, filed Feb. 9, 2016, Liu et al.

U.S. Appl. No. 17/160,329, filed Jan. 27, 2021, Liu et al.

U.S. Appl. No. 15/029,602, filed Apr. 14, 2016, Ritter et al.

U.S. Appl. No. 14/462,163, filed Aug. 18, 2014, Liu et al.

U.S. Appl. No. 14/462,189, filed Aug. 18, 2014, Liu et al.

U.S. Appl. No. 14/916,679, filed Mar. 4, 2016, Liu et al.

U.S. Appl. No. 16/860,639, filed Apr. 28, 2020, Liu et al.

U.S. Appl. No. 14/320,498, filed Jun. 30, 2014, Liu et al.

U.S. Appl. No. 14/320,467, filed Jun. 30, 2014, Liu et al.

U.S. Appl. No. 14/916,681, filed Mar. 4, 2016, Liu et al.

U.S. Appl. No. 17/103,233, filed Nov. 24, 2020, Liu et al.

U.S. Appl. No. 14/326,329, filed Jul. 8, 2014, Liu et al.

U.S. Appl. No. 14/326,340, filed Jul. 8, 2014, Liu et al.

(56) References Cited

OTHER PUBLICATIONS

U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 17/408,306, filed Aug. 20, 2021, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 17/527,011, filed Nov. 15, 2021, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 16/492,548, filed Sep. 9, 2019, Maianti et al.
U.S. Appl. No. 15/784,033, filed Oct. 13, 2017, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 17/586,688, filed Jan. 27, 2022, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/976,047, filed Aug. 26, 2020, Liu et al.
U.S. Appl. No. 17/593,020, filed Sep. 3, 2021, Church et al.
PCT/US2020/033873, Aug. 31, 2020, International Search Report and Written Opinion.
PCT/US2020/033873, Dec. 2, 2021, International Preliminary Report on Patentability,
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 61/874,682, filed Sep. 6, 2013, Liu et al.
U.S. Appl. No. 61/874,746, filed Sep. 6, 2013, Liu et al.
U.S. Appl. No. 62/288,661, filed Jan. 29, 2016, Muir et al.
U.S. Appl. No. 62/357,332, filed Jun. 30, 2016, Liu et al.
International Search Report and Written Opinion for PCT/US2020/033873, mailed Aug. 31, 2020.
International Preliminary Report on Patentability, mailed Dec. 2, 2021, in connection with Application No. PCT/US2020/033873.
[No Author Listed] "FokI" from New England Biolabs Inc. Last accessed online via https://www.neb.com/products/r0109-foki#Product%20Information on Mar. 19, 2021. 1 page.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C ->U editing enzyme APOBEC-1 [Peromyscus maniculatus bairdii], XP002793540. Mar. 21, 2016.
[No Author Listed] NCBI Accession No. XP_021505673.1. C ->U editing enzyme APOBEC-1 [Meriones unguiculatus], XP002793541. Jun. 27, 2017.
[No Author Listed] NCBI Reference Sequence: WP_00087959824.1. Oct. 9, 2019. 2 pages.
[No Author Listed] NCBI Reference Sequence: WP_001516895.1. Mar. 13, 2021. 2 pages.
[No Author Listed] Nucleic Acid Data from New England Biolabs. Printed Sep. 28, 2021. 1 page.
[No Author Listed] Score result for SEQ 355 to W02017032580. Muir et al. 2016.
[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed] Transcription activator-like effector nuclease. Wikipedia. Last edited Sep. 27, 2021. Accessed via https://en.wikipedia.org/w/index.php?title=Transcription_activator-like_effector_nuclease&oldid=1046813325 on Sep. 28, 2021. 9 pages.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.

(56) References Cited

OTHER PUBLICATIONS

Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Aihara et al., A conformational switch controls the DNA cleavage activity of lambda integrase. Mol Cell. Jul. 2003;12(1):187-98.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with No. detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Akopian et al., Chimeric recombinases with designed DNA sequence recognition. Proc Natl Acad Sci U S A. Jul. 22, 2003;100(15):8688-91. Epub Jul. 1, 2003.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known Y-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science.1589762.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

(56) References Cited

OTHER PUBLICATIONS

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Bae et al., Microhomology-based choice of Cas9 nuclease target sites. Nat Methods. Jul. 2014;11(7):705-6. doi: 10.1038/nmeth.3015.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in Saccharomyces cerevisiae. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi: 10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an N-terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basturea et al., Substrate specificity and properties of the Escherichia coli 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Behr, Gene transfer with synthetic cationic amphiphiles: prospects for gene therapy. Bioconjug Chem. Sep.-Oct. 1994;5(5):382-9. doi: 10.1021/bc00029a002.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, HCN channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex VIVO in VIVO gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 26, 2019;10(1):1937. doi: 10.1038/s41467-019-09987-0.
Beumer et al., Efficient gene targeting in Drosophila with zinc-finger nucleases. Genetics. Apr. 2006;172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection

(56) References Cited

OTHER PUBLICATIONS during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast *Torulaspora delbrueckii*. Plasmid. 1997;38(3):202-9. doi: 10.1006/plas.1997.1315.
Blau et al., A proliferation switch for genetically modified cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/i17/Improved-route-single-base-genome.html.
Bourinet et al., Silencing of the Cav3.2 T-type calcium channel gene in sensory neurons demonstrates its major role in nociception. embo J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/1061186310001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALATI noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Bulow et al., Multienzyme systems obtained by gene fusion. Trends Biotechnol. Jul. 1991;9(7):226-31.
Burke et al., Activating mutations of Tn3 resolvase marking interfaces important in recombination catalysis and its regulation. Mol Microbiol. Feb. 2004;51(4):937-48.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.

(56) References Cited

OTHER PUBLICATIONS

Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003;10(6):533-40. doi: 10.1016/s1074-5521(03)00109-1.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Böck et al., Selenocysteine: the 21st amino acid. Mol Microbiol. Mar. 1991;5(3):515-20.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Cargill et al., Characterization of single-nucleotide polymorphisms in coding regions of human genes. Nat Genet. Jul. 1999;22(3):231-8.
Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carr et al., Genome engineering. Nat Biotechnol. Dec. 2009;27(12):1151-62. doi: 10.1038/nbt.1590.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, a CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.
Chan et al., Molecular recording of mammalian embryogenesis. Nature. Jun. 2019;570(7759):77-82. doi: 10.1038/s41586-019-1184-5. Epub May 13, 2019.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chapman et al., Playing the end game: DNA double-strand break repair pathway choice. Mol Cell. Aug. 24, 2012;47(4):497-510. doi: 10.1016/j.molcel.2012.07.029.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.
Charpentier et al., Biotechnology: Rewriting a genome. Nature. Mar. 7, 2013;495(7439):50-1. doi: 10.1038/495050a.
Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.
Chavez et al., Therapeutic applications of the ?C31 integrase system. Curr Gene Ther. Oct. 2011;11(5):375-81. Review.
Chelico et al., Biochemical basis of immunological and retroviral responses to DNA-targeted cytosine deamination by activation-

(56) References Cited

OTHER PUBLICATIONS induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chesnoy et al., Structure and function of lipid-DNA complexes for gene delivery. Annu Rev Biophys Biomol Struct. 2000;29:27-47.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chichili et al., Linkers in the structural biology of protein-protein interactions. Protein Science. 2013;22:153-67.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999; 181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Choi et at al., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.
Chong et al., Modulation of protein splicing of the Saccharomyces cerevisiae vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al, Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.

(56) References Cited

OTHER PUBLICATIONS

Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/gb-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI:10.2174/138945011701151217110917.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Database EBI Accession No. ADE34233 Jan. 29, 2004.
Database EBI Accession No. BFF09785. May 31, 2018. 2 pages.
Database EBI Accession No. BGE38086. Jul. 25, 2019. 2 pages.
Database UniProt Accession No. G813E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.
Davis et al., DNA double strand break repair via non-homologous end-joining. Transl Cancer Res. Jun. 2013;2(3):130-143.

(56) References Cited

OTHER PUBLICATIONS

Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
Dekosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dicarlo et al., Genome engineering in *Saccharomyces cerevisiae* using CRISPR-Cas systems. Nucleic Acids Research Apr. 2013;41(7):4336-43.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., Experimental interrogation of the path dependence and stochasticity of protein evolution using phage-assisted continuous evolution. Proc Natl Acad Sci USA. May 2013;110(22):9007-12.
Dillon, Regulating gene expression in gene therapy. Trends Biotechnol. May 1993;11(5):167-73. doi: 10.1016/0167-7799(93)90109-M.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna et al., Genome editing. The new frontier of genome engineering with CRISPR-Cas9. Science. Nov. 28, 2014;346(6213):1258096. doi: 10.1126/science.1258096.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci USA. Aug. 15, 1991;88(16):7160-4.
Dubois et al., Retroviral RNA Dimerization: From Structure to Functions. Front Microbiol. Mar. 22, 2018;9:527. doi: 10.3389/fmicb.2018.00527.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.

(56) References Cited

OTHER PUBLICATIONS

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

During et al., Controlled release of dopamine from a polymeric brain implant: in vivo characterization. Ann Neurol. Apr. 1989;25(4):351-6.

East-Seletsky et al., Two distinct RNase activities of CRISPR-C2c2 enable guide-RNA processing and RNA detection. Nature Oct. 2016;538(7624):270-3.

Edlund et al., Cell-specific expression of the rat insulin gene: evidence for role of two distinct 5' flanking elements. Science. Nov. 22, 1985;230(4728):912-6. doi: 10.1126/science.3904002.

Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.

Edwards et al., Crystal structures of the thi-box riboswitch bound to thiamine pyrophosphate analogs reveal adaptive RNA-small molecule recognition. Structure. Sep. 2006;14(9):1459-68.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Emery et al., HCN2 ion channels play a central role in inflammatory and neuropathic pain. Science. Sep. 9, 2011;333(6048):1462-6. doi: 10.1126/science.1206243.

Endo et al., Toward establishing an efficient and versatile gene targeting system in higher plants. Biocatalysis and Agricultural Biotechnology 2014;3,(1):2-6.

Engel et al., The emerging role of mRNA methylation in normal and pathological behavior. Genes Brain Behav. Mar. 2018; 17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Epstein, HSV-1-based amplicon vectors: design and applications. Gene Ther. Oct. 2005;12 Suppl 1:S154-8. doi: 10.1038/sj.gt.3302617.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Esvelt et al., A system for the continuous directed evolution of biomolecules. Nature. Apr. 28, 2011;472(7344):499-503. doi: 10.1038/nature09929. Epub Apr. 10, 2011.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Fagerlund et al., The Cpf1 CRISPR-Cas protein expands genome-editing tools. Genome Biology Nov. 17, 2015;16:251. https://doi.org/10.1186/s13059-015-0824-9.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fang et al., Synthetic Studies Towards Halichondrins: Synthesis of the Left Halves of Norhalichondrins and Homohalichondrins. Tetrahedron Letters 1992;33(12):1557-1560.

Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.

Farhood et al., Codelivery to mammalian cells of a transcriptional factor with cis-acting element using cationic liposomes. Anal Biochem. Feb. 10, 1995;225(1):89-93.

Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Ferretti et al., Complete genome sequence of an M1 strain of *Streptococcus pyogenes*. Proc Natl Acad Sci U S A. Apr. 10, 2001;98(8):4658-63.

Ferry et al., Rational design of inducible CRISPR guide RNAs for de novo assembly of transcriptional programs. Nat Commun. Mar. 3, 2017;8:14633. doi: 10.1038/ncomms14633.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

(56) References Cited

OTHER PUBLICATIONS

Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fogg et al., New applications for phage integrases. J Mol Biol. Jul. 29, 2014;426(15):2703-16. doi: 10.1016/j.jmb.2014.05.014. Epub May 22, 2014.
Fogg et al., Genome Integration and Excision by a New *Streptomyces* Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.
Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short- and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Fusi et al., In Silico Predictive Modeling of CRISPR/Cas9 guide efficiency. Jun. 26, 2015; bioRxiv. http://dx.doi.org/10.1101/021568.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci US A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Prime editing in mice reveals the essentiality of a single base in driving tissue- specific gene expression. Genome Biol. Mar. 16, 2021;22(1):83. doi: 10.1186/s13059-021-02304-3.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garibyan et al., Use of the rpoB gene to determine the specificity of base substitution mutations on the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.

(56) References Cited

OTHER PUBLICATIONS

Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GENBANK Submission; NIH/NCBI Accession No. NM_001319224.2. Umar et al., Apr. 21, 2021. 7 pages.
GENBANK Submission; NIH/NCBI Accession No. NM_006027.4. Umar et al., Apr. 10, 2021. 7 pages.
GENBANK Submission; NIH/NCBI, Accession No. AAA66622.1. Martinelli et al., May 18, 1995. 2 pages.
GENBANK Submission; NIH/NCBI, Accession No. AGT42196. Farzadfar et al., Nov. 2, 2013. 2 pages.
GENBANK Submission; NIH/NCBI, Accession No. APG80656.1. Burstein et al., Dec. 10, 2016. 1 pages.
GENBANK Submission; NIH/NCBI, Accession No. AYD60528.1. Ram et al., Oct. 2, 2018. 1 page.
GENBANK Submission; NIH/NCBI, Accession No. BDB43378. Zhang et al., Aug. 11, 2016. 2 pages.
GENBANK Submission; NIH/NCBI, Accession No. J04623. Kita et al., Apr. 26, 1993. 2 pages.
GENBANK Submission; NIH/NCBI, Accession No. KR710351.1. Sahni et al., Jun. 1, 2015. 2 pages.
GENBANK Submission; NIH/NCBI, Accession No. NC 002737.2. Nasser et al., Feb. 7, 2021. 2 pages.
GENBANK Submission; NIH/NCBI, Accession No. NC_002737.1. Ferretti et al., Jun. 27, 2013. 1 page.
GENBANK Submission; NIH/NCBI, Accession No. NC_015683.1. Trost et al., Jul. 6, 2013. 1 page.
GENBANK Submission; NIH/NCBI, Accession No. NC_016782.1. Trost et al., Jun. 11, 2013. 1 page.
GENBANK Submission; NIH/NCBI, Accession No. NC_016786.1. Trost et al., Aug. 28, 2013. 1 page.
GENBANK Submission; NIH/NCBI, Accession No. NC_017053.1. Fittipaldi et al., Jul. 6, 2013. 1 page.
GENBANK Submission; NIH/NCBI, Accession No. NC_017317.1. Trost et al., Jun. 11, 2013. 1 page.
GENBANK Submission; NIH/NCBI, Accession No. NC_017861.1. Heidelberg et al., Jun. 11, 2013. 1 page.
GENBANK Submission; NIH/NCBI, Accession No. NC_018010.1. Lucas et al., Jun. 11, 2013. 2 pages.
GENBANK Submission; NIH/NCBI, Accession No. NC_018721.1. Feng et al., Jun. 11, 2013. 1 pages.
GENBANK Submission; NIH/NCBI, Accession No. NC_021284.1. Ku et al., Jul. 12, 2013. 1 page.
GENBANK Submission; NIH/NCBI, Accession No. NC_021314.1. Zhang et al., Jul. 15, 2013. 1 page.
GENBANK Submission; NIH/NCBI, Accession No. NC_021846.1. Lo et al., Jul. 22, 2013. 1 page.
GENBANK Submission; NIH/NCBI, Accession No. NM_000311.5. Alves et al., Mar. 7, 2021. 5 pages.
GENBANK Submission; NIH/NCBI, Accession No. NM_001319224. Umar et al., Apr. 21, 2021. 7 pages.
GENBANK Submission; NIH/NCBI, Accession No. NM_002945.3. Weiser et al., Sep. 3, 2017. 5 pages.
GENBANK Submission; NIH/NCBI, Accession No. NM_002946.5. Kavli et al., Jun. 26, 2021. 5 pages.
GENBANK Submission; NIH/NCBI, Accession No. NM_002947.4. Xiao et al., May 1, 2019. 4 pages.
GENBANK Submission; NIH/NCBI, Accession No. NM_003686. Umar et al., Apr. 9, 2021. 7 pages.
GENBANK Submission; NIH/NCBI, Accession No. NM_003686.4. Umar et al., Apr. 9, 2021. 7 pages.
GENBANK Submission; NIH/NCBI, Accession No. NM_006027. Umar et al., Apr. 10, 2021. 7 pages.
GENBANK Submission; NIH/NCBI, Accession No. NM_174936. Guo et al., Oct. 28, 2015. 6 pages.
GENBANK Submission; NIH/NCBI, Accession No. NP_000302.1. Alves et al., Mar. 7, 2021. 4 pages.
GENBANK Submission; NIH/NCBI, Accession No. NP_001243439.1. Lee et al., Jul. 26, 2021. 4 pages.
GENBANK Submission; NIH/NCBI, Accession No. NP_076161.2. Wade et al., Jun. 20, 2021. 4 pages.
GENBANK Submission; NIH/NCBI, Accession No. NP_358988.1. Hoskins et al., Jan. 11, 2017. 2 pages.
GENBANK Submission; NIH/NCBI, Accession No. NP_391970.1. Borriss et al., Feb. 12, 2021. 3 pages.
GENBANK Submission; NIH/NCBI, Accession No. NP_472073.1. Glaser et al., Jun. 27, 2013. 2 pages.
GENBANK Submission; NIH/NCBI, Accession No. NP_628093.1. Hsiao et al., Aug. 3, 2016. 2 pages.
GENBANK Submission; NIH/NCBI, Accession No. NP_955579.1. Chen et al., Aug. 13, 2018. 5 pages.
GENBANK Submission; NIH/NCBI, Accession No. P42212. Prasher et al., Mar. 19, 2014. 7 pages.
GENBANK Submission; NIH/NCBI, Accession No. QBJ66766. Duan et al. Aug. 12, 2020. 2 pages.
GENBANK Submission; NIH/NCBI, Accession No. RFF81513.1. Zhou et al., Aug. 21, 2018. 2 pages.
GENBANK Submission; NIH/NCBI, Accession No. SNX31424.1. Weckx, S., Feb. 16, 2018. 2 pages.
GENBANK Submission; NIH/NCBI, Accession No. TGH57013. Xu et al., Apr. 9, 2019. 2 pages.
GENBANK Submission; NIH/NCBI, Accession No. WP_016631044.1. Haft et al., Sep. 22, 2020. 1 page.
GENBANK Submission; NIH/NCBI, Accession No. WP_031386437. No Author Listed., Sep. 23, 2019. 1 page.
GENBANK Submission; NIH/NCBI, Accession No. WP_031589969.1. Haft et al., Oct. 9, 2019. 2 pages.
GENBANK Submission; NIH/NCBI, Accession No. WP_044924278.1. Haft et al., Oct. 9, 2019. 2 pages.
GENBANK Submission; NIH/NCBI, Accession No. WP_047338501.1. Haft et al., Oct. 9, 2019. 2 pages.
GENBANK Submission; NIH/NCBI, Accession No. WP_060798984.1. Haft et al., Oct. 9, 2019. 2 pages.
GENBANK Submission; NIH/NCBI, Accession No. WP_062913273.1. Haft et al., Oct. 9, 2019, 2 pages.
GENBANK Submission; NIH/NCBI, Accession No. WP_072754838. No Author Listed., Sep. 23, 2019. 1 page.
GENBANK Submission; NIH/NCBI, Accession No. WP_095142515.1. No Author Listed., Sep. 23, 2019. 1 page.
GENBANK Submission; NIH/NCBI, Accession No. WP_118538418.1. No Author Listed., Oct. 13, 2019. 1 page.
GENBANK Submission; NIH/NCBI, Accession No. WP_119223642.1. No Author Listed., Oct. 13, 2019. 1 page.
GENBANK Submission; NIH/NCBI, Accession No. WP_119227726.1. No Author Listed., Oct. 13, 2019. 1 page.
GENBANK Submission; NIH/NCBI, Accession No. WP_119623382.1. No Author Listed., Oct. 13, 2019. 1 page.
GENBANK Submission; NIH/NCBI, Accession No. WP_132221894.1. No Author Listed., Sep. 23, 2019. 1 page.
GENBANK Submission; NIH/NCBI, Accession No. WP_133478044.1. Haft et al., Oct. 9, 2019. 2 pages.
GENBANK Submission; NIH/NCBI, Accession No. YP_002004532.1. Villegas et al., Oct. 11, 2021. 2 pages.
GENBANK Submission; NIH/NCBI, Accession No. YP_002342100.1. Bernardini et al., Jun. 10, 2013. 2 pages.
GENBANK Submission; NIH/NCBI, Accession No. YP_002344900.1. Gundogdu et al., Mar. 19, 2014. 2 pages.
GENBANK Submission; NIH/NCBI, Accession No. YP_006589943.1. Lynch et al., Oct. 15, 2021. 2 pages.
GENBANK Submission; NIH/NCBI, Accession No. YP_009137104.1. Davison, Aug. 13, 2018. 2 pages.
GENBANK Submission; NIH/NCBI, Accession No. YP_009283008.1. Bernardini et al., Sep. 23, 2016. 2 pages.
GENBANK Submission; NIH/NCBI, Accession No. YP_820832.1. Makarova et al., Aug. 27, 2013. 2 pages.

(56) References Cited

OTHER PUBLICATIONS

George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.

(56) References Cited

OTHER PUBLICATIONS

Guo et al., Structure of Cre recombinase complexed with DNA in a site-specific recombination synapse. Nature. Sep. 4, 1997;389(6646):40-6.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibio18/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanna et al., Massively parallel assessment of human variants with base editor screens. Cell. Feb. 18, 2021;184(4):1064-1080.e20. doi: 10.1016/j.cell.2021.01.012.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Harms et al., Evolutionary biochemistry: revealing the historical and physical causes of protein properties. Nat Rev Genet. Aug. 2013;14(8):559-71. doi: 10.1038/nrg3540.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.
Harris et al., RNA Editing Enzyme APOBEC1 and Some of Its Homologs Can Act as DNA Mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hartung et al., Cre mutants with altered DNA binding properties. J Biol Chem. Sep. 4, 1998;273(36):22884-91.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hector et al., CDKL5 variants: Improving our understanding of a rare neurologic disorder. Neurol Genet. Dec. 15, 2017;3(6):e200. doi: 10.1212/NXG.0000000000000200.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendricks et al., The S. cerevisiae Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herschhorn et al., Retroviral reverse transcriptases. Cell Mol Life Sci. Aug. 2010;67(16):2717-47. doi: 10.1007/s00018-010-0346-2. Epub Apr. 1, 2010.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Hoang et al., UFBoot2: Improving the Ultrafast Bootstrap Approximation. Mol Biol Evol. Feb. 1, 2018;35(2):518-522. doi: 10.1093/molbev/msx281.

(56) References Cited

OTHER PUBLICATIONS

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 27, 2016.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.
Hoogenboom et al., Natural and designer binding sites made by phage display technology. Immunol Today. Aug. 2000;21(8):371-8.
Horvath et al., CRISPR/Cas, the immune system of bacteria and archaea. Science. Jan. 8, 2010;327(5962):167-70. doi: 10.1126/science.1179555.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hotta et al., [Neurotropic viruses—classification, structure and characteristics]. Nihon Rinsho. Apr. 1997;55(4):777-82. Japanese.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 2, 20025;98(2-3):145-60.
Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.
Hsu et al., PrimeDesign software for rapid and simplified design of prime editing guide RNAs. Nat Commun. Feb. 15, 2021;12(1):1034. doi: 10.1038/s41467-021-21337-7.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.
Huang et al., Heritable gene targeting in zebrafish using customized TALENs. Nat Biotechnol. Aug. 5, 2011;29(8):699-700. doi: 10.1038/nbt.1939.
Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.
Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.
Humbert et al., Targeted gene therapies: tools, applications, optimization. Crit Rev Biochem Mol Biol. May-Jun. 2012;47(3):264-81. doi: 10.3109/10409238.2012.658112.
Hung et al., Protein localization in disease and therapy. J Cell Sci. Oct. 15, 2011;124(Pt 20):3381-92. doi: 10.1242/jcs.089110.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Husimi, Selection and evolution of bacteriophages in cellstat. Adv Biophys. ; 1989;25:1-43. Review.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.
Hwang et al., Web-based design and analysis tools for CRISPR base editing. BMC Bioinformatics. Dec. 27, 2018;19(1):542. doi: 10.1186/s12859-018-2585-4.
Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.
Ibba et al., Substrate specificity is determined by amino acid binding pocket size in *Escherichia coli* phenylalanyl-tRNA synthetase. Biochemistry. Jun. 14, 1994;33(23):7107-12.
Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.
Iida et al., A site-specific, conservative recombination system carried by bacteriophage P1. Mapping the recombinase gene cin and the cross-over sites cix for the inversion of the C segment. EMBO J. 1982;1(11):1445-53.
Iida et al., The Min DNA inversion enzyme of plasmid p15B of *Escherichia coli* 15T—: a new member of the Din family of site-specific recombinases. Mol Microbiol. Jun. 1990;4(6):991-7. doi: 10.1111/j.1365-2958.1990.tb00671.x.
Ikediobi et al., Mutation analysis of 24 known cancer genes in the NCI-60 cell line set. Mol Cancer Ther. Nov. 2006;5(11):2606-12. Epub Nov. 6, 2006.
Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.
Imburgio et al., Studies of promoter recognition and start site selection by T7 RNA polymerase using a comprehensive collection of promoter variants. Biochemistry. Aug. 29, 2000;39(34):10419-30.
Ingram, A specific chemical difference between the globins of normal human and sickle-cell anaemia haemoglobin. Nature. Oct. 13, 1956;178(4537):792-4. doi: 10.1038/178792a0.
Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

(56) References Cited

OTHER PUBLICATIONS

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Iwai et al., Circular beta-lactamase: stability enhancement by cyclizing the backbone. FEBS Lett. Oct. 8, 1999;459(2):166-72. doi: 10.1016/s0014-5793(99)01220-x.
Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.
Jaffrey et al., Emerging links between m6A and misregulated mRNA methylation in cancer. Genome Med. Jan. 12, 2017;9(1):2. doi: 10.1186/s13073-016-0395-8.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.
Jasin et al., Repair of strand breaks by homologous recombination. Cold Spring Harb Perspect Biol. Nov. 1, 2013;5(11):a012740. doi: 10.1101/cshperspect.a012740.
Jeggo, DNA breakage and repair. Adv Genet. 1998;38:185-218. doi: 10.1016/s0065-2660(08)60144-3.
Jemielity et al., Novel “anti-reverse” cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.
Jiang et al., Chemical modifications of adenine base editor mRNA and guide RNA expand its application scope. Nat Commun. Apr. 24, 2020;11(1):1979. doi: 10.1038/s41467-020-15892-8.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jiricny, The multifaceted mismatch-repair system. Nat Rev Mol Cell Biol. May 2006;7(5):335-46. doi: 10.1038/nrm1907.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johansson et al., RNA Recognition by the MS2 Phage Coat Protein. Seminars in Virology. 1997;8(3):176-85. https://doi.org/10.1006/smvy.1997.0120.
Johansson et al., Selenocysteine in proteins-properties and biotechnological use. Biochim Biophys Acta. Oct. 30, 2005;1726(1):1-13. Epub Jun. 1, 2005.
Johns et al., The promise and peril of continuous in vitro evolution. J Mol Evol. Aug. 2005;61(2):253-63. Epub Jun. 27, 2005.
Joho et al., Identification of a region of the bacteriophage T3 and T7 Rna polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al., TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.
Jyothy et al., Translocation Down syndrome. Indian J Med Sci. Mar. 2002;56(3):122-6.
Kacian et al., Purification of the DNA polymerase of avian myeloblastosis virus. Biochim Biophys Acta. Sep. 24, 1971;246(3):365-83. doi: 10.1016/0005-2787(71)90773-8.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.

(56) References Cited

OTHER PUBLICATIONS

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kavli et al., Excision of cytosine and thymine from DNA by mutants of human uracil-DNA glycosylase. EMBO J. Jul. 1, 1996;15(13):3442-7.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kay et al., Viral vectors for gene therapy: the art of turning infectious agents into vehicles of therapeutics. Nat Med. Jan. 2001;7(1):33-40.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, Pcna: structure, functions and interactions. Oncogene. Feb. 13, 1997;14(6):629-40. doi: 10.1038/sj.onc.1200886.
Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.
Kessel et al., Murine developmental control genes. Science. Jul. 27, 1990;249(4967):374-9. doi: 10.1126/science.1974085.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., In vivo high-throughput profiling of CRISPR-Cpf1 activity. Nat Methods. Feb. 2017;14(2):153-159. doi: 10.1038/nmeth.4104. Epub Dec. 19 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 1, 20093;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.

(56) References Cited

OTHER PUBLICATIONS

Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb. 1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with No. detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.
Koblan et al., Efficient CoG-to-GoC base editors developed using CRISPRi screens, target-library analysis, and machine learning. Nature Biotechnol. Jun. 28, 2021. https://doi.org/10.1038/s41587-021-00938-z.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc. M110.177402. Epub Oct. 6, 2010.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Koonin et al., Diversity, classification and evolution of CRISPR-Cas systems. Curr Opin Microbiol. 2017;37:67?78. doi:10.1016/j.mib. 2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al., Uracil in DNA—occurrence, consequences and repair. Oncogene. Dec. 16, 2002;21(58):8935-48. doi: 10.1038/sj.onc.1205996.

(56) References Cited

OTHER PUBLICATIONS

Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunkel et al., Eukaryotic Mismatch Repair in Relation to DNA Replication. Annu Rev Genet. 2015;49:291-313. doi: 10.1146/annurev-genet-112414-054722.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Kwon et al., Chemical basis of glycine riboswitch cooperativity. RNA. Jan. 2008;14(1):25-34. Epub Nov. 27, 2007.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Lada et al., Mutator effects and mutation signatures of editing deaminases produced in bacteria and yeast. Biochemistry (Mosc). Jan. 2011;76(1):131-46.
Lakich et al., Inversions disrupting the factor VIII gene are a common cause of severe haemophilia A. Nat Genet. Nov. 1993;5(3):236-41. doi: 10.1038/ng1193-236.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Lapinaite et al., DNA capture by a CRISPR-Cas9-guided adenine base editor. Science. Jul. 31, 2020;369(6503):566-571. doi: 10.1126/science.abb1390.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., ROSETTA3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., An allosteric self-splicing ribozyme triggered by a bacterial second messenger. Science. Aug. 13, 2010;329(5993):845-8. doi: 10.1126/science.1190713.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.

(56) References Cited

OTHER PUBLICATIONS

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lee et al., Simultaneous targeting of linked loci in mouse embryos using base editing. Sci Rep. Feb. 7, 2019;9(1):1662. doi: 10.1038/s41598-018-33533-5.
Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Targeted chromosomal deletions in human cells using zinc finger nucleases. Genome Res. Jan. 2010 20: 81-89; Published in Advance Dec. 1, 2009, doi:10.1101/gr.099747.109.
Lee et al., Targeting fidelity of adenine and cytosine base editors in mouse embryos. Nat Commun. Nov. 15, 2018;9(1):4804. doi: 10.1038/s41467-018-07322-7.
Lee et al., Transcriptional regulation and its misregulation in disease. Cell. Mar. 14, 2013;152(6):1237-51. doi: 10.1016/j.cell.2013.02.014.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.
Leipold et al., A de novo gain-of-function mutation in SCN11A causes loss of pain perception. Nat Genet. Nov. 2013;45(11):1399-404. doi: 10.1038/ng.2767. Epub Sep. 15, 2013.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.
Levy et al., Inhibition of calcification of bioprosthetic heart valves by local controlled-release diphosphonate. Science. Apr. 12, 1985;228(4696):190-2.
Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.
Lewis et al., Codon 129 polymorphism of the human prion protein influences the kinetics of amyloid formation. J Gen Virol. Aug. 2006;87(Pt 8):2443-9.
Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.
Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.
Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.
Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Loss of post-translational modification sites in disease. Pac Symp Biocomput. 2010:337-47. doi: 10.1142/9789814295291_0036.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Li, Mechanisms and functions of DNA mismatch repair. Cell Res. Jan. 2008;18(1):85-98. doi: 10.1038/cr.2007.115.
Liang et al., Correction of ?-thalassemia mutant by base editor in human embryos. Protein Cell. Nov. 2017;8(11):811-822. doi: 10.1007/s13238-017-0475-6. Epub Sep. 23, 2017.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lienert et al., Two- and three-input TALE-based and logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.

(56) References Cited

OTHER PUBLICATIONS

Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.
Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Liu et al., Fast Colorimetric Sensing of Adenosine and Cocaine Based on a General Sensor Design Involving Aptamers and Nanoparticles. Angew Chem. 2006;118(1):96-100.
Liu et al., Flap endonuclease 1: a central component of DNA metabolism. Annu Rev Biochem. 2004;73:589-615. doi:10.1146/annurev.biochem.73.012803.092453.
Liu et al., Functional Nucleic Acid Sensors. Chem Rev. May 2009;109(5):1948-98. doi: 10.1021/cr030183i.
Liu et al., Genetic incorporation of unnatural amino acids into proteins in mammalian cells. Nat Methods. Mar. 2007;4(3):239-44. Epub Feb. 25, 2007.
Liu et al., Highly efficient RNA-guided base editing in rabbit. Nat Commun. Jul. 13, 2018;9(1):2717. doi: 10.1038/s41467-018-05232-2.
Liu et al., N(6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., Reverse transcriptase of foamy virus. Purification of the enzymes and immunological identification. Arch Virol. 1977;55(3):187-200. doi: 10.1007/BF01319905.
Liu et al., Reverse transcriptase-mediated tropism switching in Bordetella bacteriophage. Science. Mar. 15, 2002;295(5562):2091-4. doi: 10.1126/science.1067467.
Liu et al., Saccharomyces cerevisiae flap endonuclease 1 uses flap equilibration to maintain triplet repeat stability. Mol Cell Biol. May 2004;24(9):4049-64. doi: 10.1128/MCB.24.9.4049-4064.2004.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase- defective lentiviral vector delivery. Nat Biotechnol. Nov. 2007;25(11):1298-306. Epub Oct. 28, 2007.
Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.
Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.
Lorenz et al., ViennaRNA Package 2.0. Algorithms Mol Biol. Nov. 24, 2011;6:26. doi: 10.1186/1748-7188-6-26.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.
Luckow et al., High level expression of nonfused foreign genes with Autographa californica nuclear polyhedrosis virus expression vectors. Virology. May 1989;170(1):31-9. doi: 10.1016/0042-6822(89)90348-6.
Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

(56) References Cited

OTHER PUBLICATIONS

Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with Escherichia coli uracil-DNA glycosylase. J Biol Chem. Aug. 22, 1997;272(34):21408-19.
Lynch, Evolution of the mutation rate. Trends Genet. Aug. 2010;26(8):345-52. doi: 10.1016/j.tig.2010.05.003. Epub Jun. 30, 2010.
Lyons et al., Efficient Recognition of an Unpaired Lesion by a DNA Repair Glycosylase. J. Am. Chem. Soc., 2009;131(49):17742-3. DOI: 10.1021/ja908378y.
Luke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.
Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.
Ma et al., In vitro protein engineering using synthetic tRNA(Ala) with different anticodons. Biochemistry. Aug. 10, 1993;32(31):7939-45.
Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Ma et al., Targeted AID-mediated mutagenesis (TAM) enables efficient genomic diversification in mammalian cells. Nature Methods. Oct. 2016;13:1029-35. doi: 10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
Macbeth et al., Inositol hexakisphosphate is bound in the ADAR2 core and required for RNA editing. Science. Sep. 2, 2005;309(5740):1534-9. doi: 10.1126/science.1113150.
Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? CRISPR J. Oct. 2018; 1(5):325-336. doi: 10.1089/crispr.2018.0033.
Makarova et al., Evolution and classification of the CRISPR-Cas systems. Nat Rev Microbiol. Jun. 2011;9(6):467-77. doi: 10.1038/nrmicro2577. Epub May 9, 2011.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Makeyev et al., Evolutionary potential of an RNA virus. J Virol. Feb. 2004;78(4):2114-20.
Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).
Mali et al., Cas9 as a versatile tool for engineeringbiology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.
Marraffini et al., CRISPR interference limits horizontal gene transfer in staphylococci by targeting DNA. Science. Dec. 19, 2008;322(5909):1843-5. doi: 10.1126/science.1165771.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Marzec et al., Prime Editing: A New Way for Genome Editing. Trends Cell Biol. Apr. 2020;30(4):257-259. doi: 10.1016/j.tcb.2020.01.004. Epub Jan. 27, 2020.

(56) References Cited

OTHER PUBLICATIONS

Mascola et al., HIV-1 neutralizing antibodies: understanding nature's pathways. Immunol Rev. Jul. 2013;254(1):225-44. doi: 10.1111/imr.12075.

Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

Mcinerney et al., Error Rate Comparison during Polymerase Chain Reaction by DNA Polymerase. Mol Biol Int. 2014;2014:287430. doi: 10.1155/2014/287430. Epub Aug. 17, 2014.

Mckenna et al., Recording development with single cell dynamic lineage tracing. Development. Jun. 27, 2019;146(12):dev169730. doi: 10.1242/dev.169730.

Mckenna et al., Whole-organism lineage tracing by combinatorial and cumulative genome editing. Science. Jul. 29, 2016;353(6298):aaf7907. doi: 10.1126/science.aaf7907. Epub May 26, 2016.

Mcnaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.

Mcvey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. N Engl J Med. Nov. 19, 2009;361(21):2056-65. doi: 10.1056/NEJMoa0809716.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Mertens et al., Site-specific recombination in bacteriophage Mu: characterization of binding sites for the DNA invertase Gin. Embo J. Apr. 1988;7(4):1219-27.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Meyer et al., Library generation by gene shuffling. Curr Protoc Mol Biol. Jan. 6, 2014;105:Unit 15.12.. doi: 10.1002/0471142727.mb1512s105.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Miller, Human gene therapy comes of age. Nature. Jun. 11, 1992;357(6378):455-60. doi: 10.1038/357455a0.

Mills et al., Protein splicing in trans by purified N- and C-terminal fragments of the Mycobacterium tuberculosis RecA intein. Proc Natl Acad Sci U S A. Mar. 31, 1998;95(7):3543-8. doi: 10.1073/pnas.95.7.3543.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitani et al., Delivering therapeutic genes—matching approach and application. Trends Biotechnol. May 1993;11(5):162-6. doi: 10.1016/0167-7799(93)90108-L.

Mitton-Fry et al., Poly(A) tail recognition by a viral RNA element through assembly of a triple helix. Science. Nov. 26, 2010;330(6008):1244-7. doi: 10.1126/science.1195858.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

(56) References Cited

OTHER PUBLICATIONS

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714. e8. doi: 10.1016/j.molcel.2018.09.013. Epub Oct. 18, 2018. Including Supplemental Information.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mojica et al., Intervening sequences of regularly spaced prokaryotic repeats derive from foreign genetic elements. J Mol Evol. Feb. 2005;60(2):174-82.
Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.
Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.
Mol et al., Crystal structure of human uracil-DNA glycosylase in complex with a protein inhibitor: protein mimicry of DNA. Cell. Sep. 8, 1995;82(5):701-8.
Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.
Monahan et al., Site-specific incorporation of unnatural amino acids into receptors expressed in Mammalian cells. Chem Biol. Jun. 2003;10(6):573-80.
Monot et al., The specificity and flexibility of 11 reverse transcription priming at imperfect T-tracts. PLoS Genet. May 2013;9(5):e1003499. doi: 10.1371/journal.pgen.1003499. Epub May 9, 2013.
Montange et al., Structure of the S-adenosylmethionine riboswitch regulatory mRNA element. Nature. Jun. 29, 2006;441(7097):1172-5.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Morita et al., The site-specific recombination system of actinophage TG1. FEMS Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mougiakos et al., Characterizing a thermostable Cas9 for bacterial genome editing and silencing. Nat Commun. Nov. 21, 2017;8(1):1647. doi: 10.1038/s41467-017-01591-4.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Mullins et al., Transgenesis in nonmurine species. Hypertension. Oct. 1993;22(4):630-3.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Murphy, Phage recombinases and their applications. Adv Virus Res. 2012;83:367-414. doi: 10.1016/B978-0-12-394438-2.00008-6. Review.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Neel et al., Riboswitches: Classification, function and in silico approach, International Journal of Pharma Sciences and Research. 2010;1(9):409-420.
Nelson et al., Filamentous phage DNA cloning vectors: a noninfective mutant with a nonpolar deletion in gene III. Virology. 1981; 108(2): 338-50.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Newby et al., Base editing of haematopoietic stem cells rescues sickle cell disease in mice. Nature. Jun. 2, 2021. doi: 10.1038/s41586-021-03609-w. Epub ahead of print.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.

(56) References Cited

OTHER PUBLICATIONS

Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of *Staphylococcus aureus* Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria *Desulfotalea psychrophila, Flavobacterium psychrophilum, Psychrobacter arcticus, Psychrobacter cryohalolentis, Psychromonas ingrahamii, Psychroflexus torquis*, and *Photobacterium profundum*. BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
O'Maille et al., Structure-based combinatorial protein engineering (SCOPE). J Mol Biol. Aug. 23, 2002;321(4):677-91.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Oakes et al., Protein engineering of Cas9 for enhanced function. Methods Enzymol. 2014;546:491-511.
Odsbu et al., Specific N-terminal interactions of the *Escherichia coli* SeqA protein are required to form multimers that restrain negative supercoils and form foci. Genes Cells. Nov. 2005;10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Offord, Advances in Genome Editing. The Scientist, Apr. 20, 2016. http://www.the-scientist.com/?articles.view/articleNo/45903/title/Advances-in-Genome-Editing/.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Osborn et al., TALEN-based gene correction for epidermolysis bullosa. Mol Ther. Jun. 2013;21(6):1151-9. doi: 10.1038/mt.2013.56. Epub Apr. 2, 2013.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi:10.1126/science.1207339.

(56) References Cited

OTHER PUBLICATIONS

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Pan et al., Biological and biomedical applications of engineered nucleases. Mol Biotechnol. Sep. 2013;55(1):54-62. doi: 10.1007/s12033-012-9613-9.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth.4262.
Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with No. risk of genomic integration, delivers CRISPR/Cas9 for efficient gene editing. Mol Ther Methods Clin Dev. Aug. 24, 2016;3:16057. doi: 10.1038/mtm.2016.57.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Phillips, The challenge of gene therapy and DNA delivery. J Pharm Pharmacol. Sep. 2001;53(9):1169-74.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.

(56) References Cited

OTHER PUBLICATIONS

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Prasad et al., Rev1 is a base excision repair enzyme with 5'-deoxy-ribose phosphate lyase activity. Nucleic Acids Res. Dec. 15, 2016;44(22):10824-10833. doi: 10.1093/nar/gkw869. Epub Sep. 28, 2016.

Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Pruschy et al., Mechanistic studies of a signaling pathway activated by the organic dimerizer FK1012. Chem Biol. Nov. 1994;1(3):163-72. doi: 10.1016/1074-5521(94)90006-x.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

Queen et al., Immunoglobulin gene transcription is activated by downstream sequence elements. Cell. Jul. 1983;33(3):741-8. doi: 10.1016/0092-8674(83)90016-8.

Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.

Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.

Rakonjac et al., Roles of PIII in filamentous phage assembly. J Mol Biol. 1998; 282(1)25-41.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramamurthy et al., Identification of immunogenic B-cell epitope peptides of rubella virus El glycoprotein towards development of highly specific immunoassays and/or vaccine. Conference Abstract. 2019.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. BMC Mol Biol. Mar. 22, 2014;15:6. doi: 10.1186/1471-2199-15-6.

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., A compendium of RNA-binding motifs for decoding gene regulation. Nature. Jul. 11, 2013;499(7457):172-7. doi: 10.1038/nature12311.

Ray et al., Homologous recombination: ends as the means. Trends Plant Sci. Oct. 2002;7(10):435-40.

Rebar et al., Phage display methods for selecting zinc finger proteins with novel DNA-binding specificities. Methods Enzymol. 1996;267:129-49.

Rebuzzini et al., New mammalian cellular systems to study mutations introduced at the break site by non-homologous end-joining. DNA Repair (Amst). May 2, 2005;4(5):546-55.

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-1.

Rees et al., Development of hRad51-Cas9 nickase fusions that mediate HDR without double- stranded breaks. Nat Commun. May 17, 2019;10(1):2212. doi: 10.1038/s41467-019-09983-4.

Rees et al., Improving the DNA specificity and applicability of base editing through protein engineering and protein delivery. Nat Commun. Jun. 6, 2017;8:15790. doi: 10.1038/ncomms15790.

Relph et al., Recent developments and current status of gene therapy using viral vectors in the United Kingdom. BMJ. 2004;329(7470):839-842. doi:10.1136/bmj.329.7470.839.

Remy et al., Gene transfer with a series of lipophilic DNA-binding molecules. Bioconjug Chem. Nov.-Dec. 1994;5(6):647-54. doi: 10.1021/bc00030a021.

Ren et al., In-line Alignment and $Mg^2$? Coordination at the Cleavage Site of the env22 Twister Ribozyme. Nat Commun. Nov. 20, 2014;5:5534. doi: 10.1038/ncomms6534.

(56) References Cited

OTHER PUBLICATIONS

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., FLASH assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Riechmann et al., The C-terminal domain of TolA is the coreceptor for filamentous phage infection of *E. coli*. Cell. 1997; 90(2):351-60. PMID:9244308.
Ringrose et al., The Kw recombinase, an integrase from Kluyveromyces waltii. Eur J Biochem. Sep. 15, 1997;248(3):903-12. doi: 10.1111/j.1432-1033.1997.00903.x.
Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robertson et al., DNA repair in mammalian cells: Base excision repair: the long and short of it. Cell Mol Life Sci. Mar. 2009;66(6):981-93. doi: 10.1007/s00018-009-8736-z.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647- 56. doi: 10.1038/ni1463. Epub Apr. 2, 20079.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Rüfer et al., Non-contact positions impose site selectivity on Cre recombinase. Nucleic Acids Res. Jul. 1, 2002;30(13):2764-71. doi: 10.1093/nar/gkf399.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of Saccharomyces cerevisiae. Prog Nucleic Acid Res Mol Biol. 1995;51:53-91.
Sage et al., Proliferation of functional hair cells in vivo in the absence of the retinoblastoma protein. Science. Feb. 18, 2005;307(5712):1114-8. Epub Jan. 13, 2005.
Saha et al., The NIH Somatic Cell Genome Editing program. Nature. Apr. 2021;592(7853):195-204. doi: 10.1038/s41586-021-03191-1. Epub Apr. 7, 2021.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

(56) References Cited

OTHER PUBLICATIONS

Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Satomura et al., Precise genome-wide base editing by the CRISPR Nickase system in yeast. Sci Rep. May 18, 2017;7(1):2095. doi: 10.1038/s41598-017-02013-7.
Saudek et al., A preliminary trial of the programmable implantable medication system for insulin delivery. N Engl J Med. Aug. 31, 1989;321(9):574-9.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Savva et al., The structural basis of specific base-excision repair by uracil-DNA glycosylase. Nature. Feb. 9, 1995;373(6514):487-93. doi: 10.1038/373487a0.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schriefer et al., Low pressure DNA shearing: a method for random DNA sequence analysis. Nucleic Acids Res. Dec. 25, 1990;18(24):7455-6.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3'-->P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Sclimenti et al., Directed evolution of a recombinase for improved genomic integration at a native human sequence. Nucleic Acids Res. Dec. 15, 2001;29(24):5044-51.
Scott et al., Production of cyclic peptides and proteins in vivo. Proc Natl Acad Sci U S A. Nov. 23, 1999;96(24):13638-43. doi: 10.1073/pnas.96.24.13638.
Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

(56) References Cited

OTHER PUBLICATIONS

Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019;18(6):421-446. doi: 10.1038/s41573-019-0017-4.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shaikh et al., Chimeras of the Flp and Cre recombinases: tests of the mode of cleavage by Flp and Cre. J Mol Biol. Sep. 8, 2000;302(1):27-48.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Simonelli et al., Base excision repair intermediates are mutagenic in mammalian cells. Nucleic Acids Res. Aug. 2, 2005;33(14):4404-11. Print 2005.
Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

(56) References Cited

OTHER PUBLICATIONS

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sjoblom et al., The consensus coding sequences of human breast and colorectal cancers. Science. Oct. 13, 2006;314(5797):268-74. Epub Sep. 7, 2006.
Skretas et al., Regulation of protein activity with small-molecule-controlled inteins. Protein Sci. Feb. 2005;14(2):523-32. Epub Jan. 4, 2005.
Slaymaker et al., Rationally engineered Cas9 nucleases with improved specificity. Science. Jan. 1, 2016;351(6268):84-8. doi: 10.1126/science.aad5227. Epub Dec. 1, 2015.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Diversity in the serine recombinases. Mol Microbiol. Apr. 2002;44(2):299-307. Review.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Sommerfelt et al., Receptor interference groups of 20 retroviruses plating on human cells. Virology. May 1990;176(1):58-69. doi: 10.1016/0042-6822(90)90230-0.
Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Steiner et al., The neurotropic herpes viruses: herpes simplex and varicella-zoster. Lancet Neurol. Nov. 2007;6(11):1015-28. doi: 10.1016/S1474-4422(07)70267-3.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Stephens et al., The landscape of cancer genes and mutational processes in breast cancer. Nature Jun. 2012;486:400-404. doi: 10.1038/nature11017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Sterne-Weiler et al., Exon identity crisis: disease-causing mutations that disrupt the splicing code. Genome Biol. Jan. 23, 2014;15(1):201. doi: 10.1186/gb4150.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strecker et al., Engineering of CRISPR-Cas12b for human genome editing. Nat Commun. Jan. 22, 2019;10(1):212. doi: 10.1038/s41467-018-08224-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.
Sudarsan et al., An mRNA structure in bacteria that controls gene expression by binding lysine. Genes Dev. Nov. 1, 2003;17(21):2688-97.
Sudarsan et al., Riboswitches in eubacteria sense the second messenger cyclic di-GMP. Science. Jul. 18, 2008;321(5887):411-3. doi: 10.1126/science.1159519.
Suess et al., A theophylline responsive riboswitch based on helix slipping controls gene expression in vivo. Nucleic Acids Res. Mar. 5, 2004;32(4):1610-4.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

(56) References Cited

OTHER PUBLICATIONS

Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The Mycobacterium xenopi GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.

(56) References Cited

OTHER PUBLICATIONS

Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
Uniprot Consortium, UniProt: the universal protein knowledgebase. Nucleic Acids Res. Mar. 16, 2018;46(5):2699. doi: 10.1093/nar/gky092.
UNIPROT Submission; UniProt, Accession No. P01011. Last modified Jun. 11, 2014, version 2. 15 pages.
UNIPROT Submission; UniProt, Accession No. P01011. Last modified Sep. 18, 2013, version 2. 15 pages.
UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
UniProtein A0A1V6. Dec. 11, 2019.
UNIPROTKB Submission; Accession No. F0NH53. May 3, 2011. 4 pages.
UNIPROTKB Submission; Accession No. F0NN87. May 3, 2011. 4 pages.
UNIPROTKB Submission; Accession No. G3ECR1.2. No Author Listed., Aug. 12, 2020, 8 pages.
UNIPROTKB Submission; Accession No. P04264. No Author Listed., Apr. 7, 2021. 12 pages.
UNIPROTKB Submission; Accession No. P0DOC6. No Author Listed., Oct. 5, 2016. 5 pages.
UNIPROTKB Submission; Accession No. T0D7A2. Oct. 16, 2013. 10 pages.
UNIPROTKB Submission; Accession No. U2UMQ6. No Author Listed., Apr. 7, 2021, 11 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (NY). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile *Bacillus* (Geobacillus) stearothermophilus encodes a

(56) References Cited

OTHER PUBLICATIONS heat-stable reverse transcriptase. Appl Environ Microbiol. Dec. 2004;70(12):7140-7. doi: 10.1128/AEM.70.12.7140-7147.2004.
Venken et al., Genome-wide manipulations of Drosophila melanogaster with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Biotechniques. 2015:59,201-2;204;206-8.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci USA. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLoS One. 2011;6(5):e19722. doi: 10.1371/journal.pone.0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human CIC-1 chloride channels in myotonia

(56) References Cited

OTHER PUBLICATIONS congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. Embo J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.

(56) References Cited

OTHER PUBLICATIONS

Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.

Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.

Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.

Xu et al., Protein splicing: an analysis of the branched intermediate and its resolution by succinimide formation. EMBO J. Dec. 1, 1994;13(23):5517-22.

Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.

Xu et al., Sequence determinants of improved CRISPR sgRNA design. Genome Res. Aug. 2015;25(8):1147-57. doi: 10.1101/gr.191452.115. Epub Jun. 10, 2015.

Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.

Xu et al., The mechanism of protein splicing and its modulation by mutation. Embo J. Oct. 1, 1996;15(19):5146-53.

Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.

Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121./doi.org/10.1016/j.molcel.2017.02.007.

Yamamoto et al., The ons and offs of inducible transgenic technology: a review. Neurobiol Dis. Dec. 2001;8(6):923-32.

Yamamoto et al., Virological and immunological bases for HIV-1 vaccine design. Uirusu 2007;57(2):133-139. https://doi.org/10.2222/jsv.57.133.

Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.

Yamazaki et al., Segmental Isotope Labeling for Protein NMR Using Peptide Splicing. J. Am. Chem. Soc. May 22, 1998; 120(22):5591-2. https://doi.org/10.1021/ja9807760.

Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yan et al., Functionally diverse type V CRISPR-Cas systems. Science. Jan. 4, 2019;363(6422):88-91. doi: 10.1126/science.aav7271. Epub Dec. 6, 2018.

Yang et al., APOBEC: From mutator to editor. J Genet Genomics. Sep. 20, 2017;44(9):423-437. doi: 10.1016/j.jgg.2017.04.009. Epub Aug. 7, 2017.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., New CRISPR-Cas systems discovered. Cell Res. Mar. 2017;27(3):313-314. doi: 10.1038/cr.2017.21. Epub Feb. 21, 2017.

Yang et al., One Prime for All Editing. Cell. Dec. 12, 2019;179(7):1448-1450. doi: 10.1016/j.cell.2019.11.030.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., PAM-dependent Target DNA Recognition and Cleavage by C2C1 CRISPR-Cas endonuclease. Cell Dec. 2016;167(7):1814-28.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yang, PAML 4: phylogenetic analysis by maximum likelihood. Mol Biol Evol. Aug. 2007;24(8):1586-91. doi: 10.1093/molbev/msm088. Epub May 4, 2007.

Yang, Phylogenetic Analysis by Maximum Likelihood (PAML). //abacus.gene.ucl.ac.uk/software/paml.html Last accessed Apr. 28, 2021.

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasui, Alternative excision repair pathways. Cold Spring Harb Perspect Biol. Jun. 1, 2013;5(6):a012617. doi: 10.1101/cshperspect.a012617.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yazaki et al., Hereditary systemic amyloidosis associated with a new apolipoprotein AII stop codon mutation Stop78Arg. Kidney Int. Jul. 2003;64(1):11-6.

Yeh et al., In vivo base editing of post-mitotic sensory cells. Nat Commun. Jun. 5, 2018;9(1):2184. doi: 10.1038/s41467-018-04580-3.

Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.

Yokoe et al., Spatial dynamics of GFP-tagged proteins investigated by local fluorescence enhancement. Nat Biotechnol. Oct. 1996;14(10):1252-6. doi: 10.1038/nbt1096-1252.

(56) References Cited

OTHER PUBLICATIONS

Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Liposome-mediated in vivo ELA gene transfer suppressed dissemination of ovarian cancer cells that overexpress HER-2/neu. Oncogene. Oct. 5, 1995;11(7):1383-8.

Yu et al., Progress towards gene therapy for HIV infection. Gene Ther. Jan. 1994;1(1):13-26.

Yu et al., Small molecules enhance CRISPR genome editing in pluripotent stem cells. Cell Stem Cell. Feb. 5, 2015;16(2):142-7. doi: 10.1016/j.stem.2015.01.003.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Yuan et al., Laboratory-directed protein evolution. Microbiol Mol Biol Rev. 2005; 69(3):373-92. PMID: 16148303.

Yuan et al., Tetrameric structure of a serine integrase catalytic domain. Structure. Aug. 6, 2008;16(8):1275-86. doi: 10.1016/j.str.2008.04.018.

Yuen et al., Control of transcription factor activity and osteoblast differentiation in mammalian cells using an evolved small-molecule-dependent intein. J Am Chem Soc. Jul. 12, 2006;128(27):8939-46.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with Crispr Rna scaffolds. Cell. Jan. 15, 2015;160(1-2):339-50. doi: 10.1016/j.cell.2014.11.052. Epub Dec. 18, 2014.

Zelphati et al., Intracellular delivery of proteins with a new lipid-mediated delivery system. J Biol Chem. Sep. 14, 2001;276(37):35103-10. Epub Jul. 10, 2001.

Zetsche et al., A split-Cas9 architecture for inducible genome editing and transcription modulation. Nat Biotechnol. Feb. 2015;33(2):139-42. doi: 10.1038/nbt.3149.

Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., II-Clamp-mediated cysteine conjugation. Nat Chem. Feb. 2016;8(2):120-8. doi: 10.1038/nchem.2413. Epub Dec. 21, 2015.

Zhang et al., A new strategy for the site-specific modification of proteins in vivo. Biochemistry. Jun. 10, 2003;42(22):6735-46.

Zhang et al., Circular intronic long noncoding RNAs. Mol Cell. Sep. 26, 2013;51(6):792-806. doi: 10.1016/j.molcel.2013.08.017. Epub Sep. 12, 2013.

Zhang et al., Comparison of non-canonical PAMs for CRISPR/Cas9-mediated DNA cleavage in human cells. Sci Rep. Jun. 2014;4:5405.

Zhang et al., Conditional gene manipulation: Cre-ating a new biological era. J Zhejiang Univ Sci B. Jul. 2012;13(7):511-24. doi: 10.1631/jzus.B1200042. Review.

Zhang et al., Copy number variation in human health, disease, and evolution. Annu Rev Genomics Hum Genet. 2009;10:451-81. doi: 10.1146/annurev.genom.9.081307.164217.

Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.

Zhang et al., Programmable base editing of zebrafish genome using a modified CRISPR-Cas9 system. Nat Commun. Jul. 25, 2017;8(1):118. doi: 10.1038/s41467-017-00175-6.

Zhang et al., Ribozymes and Riboswitches: Modulation of RNA Function by Small Molecules. Biochemistry. Nov. 2, 2010;49(43):9123-31. doi: 10.1021/bi1012645.

Zhang et al., Stabilized plasmid-lipid particles for regional gene therapy: formulation and transfection properties. Gene Ther. Aug. 1999;6(8):1438-47.

Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., DNA editing in DNA/RNA hybrids by adenosine deaminases that act on RNA. Nucleic Acids Res. Apr. 7, 2017;45(6):3369-3377. doi: 10.1093/nar/gkx050.

Zheng et al., Highly efficient base editing in bacteria using a Cas9-cytidine deaminase fusion. Commun Biol. Apr. 19, 2018;1:32. doi: 10.1038/s42003-018-0035-5.

Zheng et al., Structural basis for the complete resistance of the human prion protein mutant G127V to prion disease. Sci Rep. Sep. 4, 2018;8(1):13211. doi: 10.1038/s41598-018-31394-6.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zielenski, Genotype and phenotype in cystic fibrosis. Respiration. 2000;67(2):117-33. doi: 10.1159/000029497.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zimmermann et al., Molecular interactions and metal binding in the theophylline-binding core of an RNA aptamer. RNA. May 2000;6(5):659-67.

Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.

Zorko et al., Cell-penetrating peptides: mechanism and kinetics of cargo delivery. Adv Drug Deliv Rev. Feb. 28, 2005;57(4):529-45. Epub Jan. 22, 2005.

(56) References Cited

OTHER PUBLICATIONS

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Zuris et al., Cationic lipid-mediated delivery of proteins enables efficient protein-based genome editing in vitro and in vivo. Nat Biotechnol. 2015;33:73-80.

[No Author Listed], "Lambda DNA" from Catalog & Technical Reference. New England Biolabs Inc. 2002/2003. pp. 133 and 270-273.

[No Author Listed], Adenine deaminase polypeptide SEQ: 49. EBI Acc. No. BJG44493. Jun. 10, 2021. 1 page.

[No Author Listed], Cas14al protein-N terminal adenine deaminase. EBI Acc. No. BKX98589, Seq. ID 265. May 26, 2022. 3 pages.

[No Author Listed], CMP/dCMP-type deaminase domain-containing protein. Uniprot Accession No. A0A2Z6RZE9. Oct. 10, 2018. Accessible at https://www.uniprot.org/uniprotkb/A0A2Z6RZE9/entry. 8 pages.

[No Author Listed], dCas9-5xPlat2AfID-P2A-scFvGCN4sfGFPTET1CD [Cloning vector pPlatTET-gRNA2]. GenBank No. BAV54124. Apr. 18, 2017. 5 pages.

[No Author Listed], Gag-Pol polyprotein. UniProtKB/Swiss-Prot No. P03355.5. Sep. 18, 2019. 18 pages.

[No Author Listed], *Homo sapiens* signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.

[No Author Listed], Multispecies: tRNA adenosine(34) deaminase TadA [Enterobacteriaceae]. NCBI Ref Seq No. WP_001297409.1. Feb. 28, 2022. Retrieved from https://www.ncbi.nlm.nih.gov/protein/WP_001297409.1/. 2 pages.

[No Author Listed], MutL homolog 1. UniProtKB Acc. No. F1MPG0. May 3, 2011. Accessible at https://rest.uniprot.org/unisave/F1MPG0?format=txt&versions=1. 1 page.

[No Author Listed], NCBI Reference Sequence: WP_032188360.1. Apr. 6, 2015. 1 page.

[No Author Listed], *Streptococcus pyogenes* Cas9 protein. EBI Acc. No. BIR16744. Jan. 21, 2021. 1 page.

[No Author Listed], *Streptococcus pyogenes* Cas9 protein. EBI Acc. No. BIR16747. Jan. 21, 2021. 1 page.

[No Author Listed], tRNA-specific adenosine deaminase [Candidatus Moranella endobia PCVAL]. GenBank Acc. No. AGJ61179.1. Accessible at https://www.ncbi.nlm.nih.gov/protein/AGJ61179. Jan. 30, 2014. 3 pages.

[No Author Listed], tRNA-specific adenosine deaminase [*Escherichia coli*]. GenBank Acc. No. CTS26096.1. Accessible at https://www.ncbi.nlm.nih.gov/protein/CTS26096.1. Aug. 22, 2015. 1 page.

[No Author Listed], RNA-specific adenosine deaminase 2 [Terrapene triunguis]. GenBank Acc. No. XP_024075810.1. Accessible at https://www.ncbi.nlm.nih.gov/protein/XP_024075810. Jul. 15, 2019. 2 pages.

[No Author Listed], tRNA-specific adenosine deaminase TAD2 isoform X1 [*Oryza sativa* Japonica Group]. GenBank Acc. No. XP_15631651.1. Accessible at https://www.ncbi.nlm.nih.gov/protein/1002254769?sat=58&satkey=133677684. Aug. 7, 2018. 2 pages.

[No Author Listed], tRNA-specific adenosine deaminase TAD2 isoform X2 [Panicum hallii]. GenBank Acc. No. XP_025793740.1. Accessible at https://www.ncbi.nlm.nih.gov/protein/025793740. Jul. 27, 2018. 1 page.

[No Author Listed], tRNA-specific adenosine deaminase. Uniprot Accession No. A0A1U7M801. May 10, 2017. Accessible at https://www.uniprot.org/uniprotkb/A0A1U7M801/history. 3 pages.

[No Author Listed], tRNA-specific adenosine deaminase. Uniprot Accession No. A0A1Z4VPW4. Sep. 27, 2017. Accessible at https://www.uniprot.org/uniprotkb/A0A1Z4VPW4/history. 3 pages.

[No Author Listed], tRNA-specific adenosine deaminase. Uniprot Accession No. A0A1Z9LYI9. Oct. 25, 2017. Accessible at https://www.uniprot.org/uniprotkb/A0A1Z9LY19/entry. 12 pages.

[No Author Listed], tRNA-specific adenosine deaminase. Uniprot Accession No. A0A2P5TOZ9. May 23, 2018. Accessible at https://www.uniprot.org/uniprotkb/A0A2P5TOZ9/entry. 10 pages.

[No Author Listed], tRNA-specific adenosine deaminase. Uniprot Accession No. A0A4P6PH16. Jul. 31, 2019. Accessible at https://www.uniprot.org/uniprotkb/A0A4P6PH16/entry. 12 pages.

[No Author Listed], tRNA-specific adenosine deaminase. Uniprot Accession No. A0A520SVM3. Oct. 16, 2019. Accessible at https://www.uniprot.org/uniprotkb/A0A520SVM3/entry. 10 pages.

[No Author Listed], tRNA-specific adenosine deaminase. Uniprot Accession No. U2JUU0. Nov. 13, 2013. Accessible at https://www.uniprot.org/uniprotkb/U2JUU0/entry. 11 pages.

Abed et al., The Gag protein PEG10 binds to RNA and regulates trophoblast stem cell lineage specification. PLoS One. Apr. 5, 2019;14(4):e0214110. doi: 10.1371/journal.pone.0214110.

Abifadel et al., Mutations in PCSK9 cause autosomal dominant hypercholesterolemia. Nat Genet. Jun. 2003;34(2):154-6. doi: 10.1038/ng1161.

Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.

Addgene Plasmid #42234. pMJ920. 2013. Retrieved Jan. 22, 2025. 3 pages.

Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.

Alanis-Lobato et al., Frequent loss of heterozygosity in CRISPR-Cas9-edited early human embryos. Proc Natl Acad Sci U S A. Jun. 1, 2021;118(22):e2004832117. doi: 10.1073/pnas.2004832117. Epub Apr. 9, 2021.

Alizadeh et al., HR9: An Important Cell Penetrating Peptide for Delivery of HCV NS3 Dna into HEK-293T Cells. Avicenna J Med Biotechnol. Jan.-Mar. 2020;12(1):44-51.

Alves et al., Immunogenicity of the carcinoembryonic antigen derived peptide 694 in HLA-A2 healthy donors and colorectal carcinoma patients. Cancer Immunol Immunother. Nov. 2007;56(11):1795-805. doi: 10.1007/s00262-007-0323-2. Epub Apr. 20, 2007.

Anderson et al., pegIT—a web-based design tool for prime editing. Nucleic Acids Res. Jul. 2, 2021;49(W1):W505-W509. doi: 10.1093/nar/gkab427.

Anzalone et al., Programmable deletion, replacement, integration and inversion of large DNA sequences with twin prime editing. Nat Biotechnol. May 2022;40(5):731-740. doi: 10.1038/s41587-021-01133-w. Epub Dec. 9, 2021.

Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.

Asemissen et al., Identification of a highly immunogenic HLA-A*01-binding T cell epitope of WT1. Clin Cancer Res. Dec. 15, 2006;12(24):7476-82. doi: 10.1158/1078-0432.CCR-06-1337.

Ashley et al., Retrovirus-like Gag Protein Arc1 Binds RNA and Traffics across Synaptic Boutons. Cell. Jan. 11, 2018;172(1-2):262-274.e11. doi: 10.1016/j.cell.2017.12.022.

Attia et al., Autoimmunity correlates with tumor regression in patients with metastatic melanoma treated with anti-cytotoxic T-lymphocyte antigen-4. J Clin Oncol. Sep. 1, 2005;23(25):6043-53. doi: 10.1200/JCO.2005.06.205. Epub Aug. 8, 2005.

(56) References Cited

OTHER PUBLICATIONS

Aurisicchio et al., A novel minigene scaffold for therapeutic cancer vaccines. Oncoimmunology. Jan. 1, 2014;3(1):e27529. doi: 10.4161/onci.27529. Epub Jan. 16, 2014.
Avidan et al., Expression and characterization of a recombinant novel reverse transcriptase of a porcine endogenous retrovirus. Virology. Mar. 15, 2003;307(2):341-57. doi: 10.1016/s0042-6822(02)00131-9.
Ayala-Ramirez et al., A new autosomal recessive syndrome consisting of posterior microphthalmos, retinitis pigmentosa, foveoschisis, and optic disc drusen is caused by a MFRP gene mutation. Mol Vis. Dec. 4, 2006;12:1483-9.
Azzam et al., FTO m6A Demethylase in Obesity and Cancer: Implications and Underlying Molecular Mechanisms. Int J Mol Sci. Mar. 30, 2022;23(7):3800. doi: 10.3390/ijms23073800.
Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.
Bae et al., Heteroclitic CD33 peptide with enhanced anti-acute myeloid leukemic immunogenicity. Clin Cancer Res. Oct. 15, 2004;10(20):7043-52. doi: 10.1158/1078-0432.CCR-04-0322.
Bae et al., Identification of novel CD33 antigen-specific peptides for the generation of cytotoxic T lymphocytes against acute myeloid leukemia. Cell Immunol. Jan. 2004;227(1):38-50. doi: 10.1016/j.cellimm.2004.01.002.
Bakker et al., Analogues of CTL epitopes with improved MHC class-I binding capacity elicit anti-melanoma CTL recognizing the wild-type epitope. Int J Cancer. Jan. 27, 1997;70(3):302-9. doi: 10.1002/(sici)1097-0215(19970127)70:3<302::aid-ijc10>3.0.co;2-h.
Banerjee et al., Viral glycoproteins: biological role and application in diagnosis. Virusdisease. Mar. 2016;27(1):1-11. doi: 10.1007/s13337-015-0293-5. Epub Jan. 18, 2016.
Baños-sanz et al., Crystal structure and functional insights into uracil-DNA glycosylase inhibition by phage Φ29 DNA mimic protein p56. Nucleic Acids Res. Jul. 2013;41(13):6761-73. doi: 10.1093/nar/gkt395. Epub May 13, 2013.
Banskota et al., Engineered virus-like particles for efficient in vivo delivery of therapeutic proteins. Cell. Jan. 20, 2022;185(2):250-265.e16. doi: 10.1016/j.cell.2021.12.021. Epub Jan. 11, 2022.
Barve et al., Induction of immune responses and clinical efficacy in a phase II trial of IDM-2101, a 10-epitope cytotoxic T-lymphocyte vaccine, in metastatic non-small-cell lung cancer. J Clin Oncol. Sep. 20, 2008;26(27):4418-25. doi: 10.1200/JCO.2008.16.6462.
Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.
Bass, B.L., RNA editing by adenosine deaminases that act on RNA. Annu Rev Biochem. 2002;71:817-46. doi: 10.1146/annurev.biochem.71.110601.135501. Epub Nov. 9, 2001.
Bender et al., Receptor-Targeted Nipah Virus Glycoproteins Improve Cell-Type Selective Gene Delivery and Reveal a Preference for Membrane-Proximal Cell Attachment. PLoS Pathog. Jun. 9, 2016;12(6):e1005641. doi: 10.1371/journal.ppat.1005641.
Benlalam et al., Identification of five new HLA-B*3501-restricted epitopes derived from common melanoma-associated antigens, spontaneously recognized by tumor-infiltrating lymphocytes. J Immunol. Dec. 1, 2003;171(11):6283-9. doi: 10.4049/jimmunol.171.11.6283.
Bernardi et al., Nucleotide sequence at the binding site for coat protein on RNA of bacteriophage R17. Proc Natl Acad Sci U S A. Oct. 1972;69(10):3033-7. doi: 10.1073/pnas.69.10.3033.
Bernatchez et al., Altered decamer and nonamer from an HLA-A0201-restricted epitope of Survivin differentially stimulate T-cell responses in different individuals. Vaccine. Apr. 5, 2011;29(16):3021-30. doi: 10.1016/j.vaccine.2011.01.115. Epub Feb. 12, 2011.
Bertsimas et al., Simulated annealing. Statistical Science. Feb. 1993;8(1):10-15. doi: 10.1214/ss/1177011077.
Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.
Bikard et al., Programmable repression and activation of bacterial gene expression using an engineered CRISPR-Cas system. Nucleic Acids Res. Aug. 2013;41(15):7429-37. doi: 10.1093/nar/gkt520. Epub Jun. 12, 2013.
Bioley et al., Melan-A/MART-1-specific CD4 T cells in melanoma patients: identification of new epitopes and ex vivo visualization of specific T cells by MHC class II tetramers. J Immunol. Nov. 15, 2006;177(10):6769-79. doi: 10.4049/jimmunol.177.10.6769.
Blanchet et al., A new generation of Melan-A/MART-1 peptides that fulfill both increased immunogenicity and high resistance to biodegradation: implication for molecular anti-melanoma immunotherapy. J Immunol. Nov. 15, 2001;167(10):5852-61. doi: 10.4049/jimmunol.167.10.5852.
Blauw et al., SMN1 gene duplications are associated with sporadic ALS. Neurology. Mar. 13, 2012;78(11):776-80. doi: 10.1212/WNL.0b013e318249f697. Epub Feb. 8, 2012.
Böck et al., In vivo prime editing of a metabolic liver disease in mice. Sci Transl Med. Mar. 16, 2022;14(636):eabl9238. doi: 10.1126/scitranslmed.abl9238. Epub Mar. 16, 2022. Author Manuscript. 26 pages.
Bolukbasi et al., DNA-binding-domain fusions enhance the targeting range and precision of Cas9. Nat Methods. Dec. 2015; 12(12):1150-6. doi: 10.1038/nmeth.3624. Epub Oct. 19, 2015.
Borbulevych et al., Increased immunogenicity of an anchor-modified tumor-associated antigen is due to the enhanced stability of the peptide/MHC complex: implications for vaccine design. J Immunol. Apr. 15, 2005;174(8):4812-20. doi: 10.4049/jimmunol.174.8.4812.
Bosch et al., Precise genome engineering in *Drosophila* using prime editing. Proc Natl Acad Sci U S A. Jan. 5, 2021;118(1):e2021996118. doi: 10.1073/pnas.2021996118.
Brichard et al., A tyrosinase nonapeptide presented by HLA-B44 is recognized on a human melanoma by autologous cytolytic T lymphocytes. Eur J Immunol. Jan. 1996;26(1):224-30. doi: 10.1002/eji.1830260135.
Brutlag et al., Improved sensitivity of biological sequence database searches. Comput Appl Biosci. Jul. 1990;6(3):237-45. doi: 10.1093/bioinformatics/6.3.237.
Bulcha et al., Viral vector platforms within the gene therapy landscape. Signal Transduct Target Ther. Feb. 8, 2021;6(1):53. doi: 10.1038/s41392-021-00487-6.
Cabeceiras, Novel Extracellular Vesicle Modalities for Delivery of Genome Editor Ribonucleoprotein Complexes. Doctoral dissertation, Harvard University Graduate School of Arts and Sciences. Apr. 29, 2022. Retrieved on Jun. 6, 2024 from: https://nrs.harvard.edu/URN-3:HUL.INSTREPOS:37372269. 138 pages.
Cacabelos et al., Chapter 1—The Epigenetic Machinery in the Life Cycle and Pharmacoepigenetics. Pharmacoepigenetics. vol. 10 in Translational Epigenetics. 2019:1-100. doi: https://doi.org/10.1016/B978-0-12-813939-4.00001-2. 7 pages.
Cai et al. Targeted genome editing by lentiviral protein transduction of zinc-finger and TAL-effector nucleases. Elife. Apr. 24, 2014;3:e01911. doi: 10.7554/eLife.01911.
Cai et al., Abstract OR021: Targeted Genome Editing by Lentiviral Protein Transduction of ZFN and Cas9 Proteins Abstract, Presented at Proceedings of the ESGCT and NVGCT Collaborative Congress: The Hague. Human Gene Therapy. 2014. 15 pages.
Cai, Protein Transduction Using Lentiviral Vectors for Transposition and Site-directed Gene Editing. Thesis for the degree of Doctor of Philosophy, Aarhus University, Department of Biomedicine. 2014. 74 pages.
Cameron et al., Mapping the genomic landscape of CRISPR-Cas9 cleavage. Nat Methods. Jun. 2017;14(6):600-606 with Erratum. doi: 10.1038/nmeth.4284. Epub May 1, 2017. Erratum in: Nat Methods. Dec. 2023;20(12):2068. doi: 10.1038/s41592-023-02114-4. 8 pages.
Campbell et al., Gesicle-Mediated Delivery of CRISPR/Cas9 Ribonucleoprotein Complex for Inactivating the HIV Provirus. Mol Ther. Jan. 2, 2019;27(1):151-163. doi: 10.1016/j.ymthe.2018.10.002. Epub Oct. 11, 2018.

(56) References Cited

OTHER PUBLICATIONS

Campi et al., CD4(+) T cells from healthy subjects and colon cancer patients recognize a carcinoembryonic antigen-specific immunodominant epitope. Cancer Res. Dec. 1, 2003;63(23):8481-6.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Casnici et al., Immunologic evaluation of peptides derived from BCR/ABL-out-of-frame fusion protein in HLA A2.1 transgenic mice. J Immunother. May 2012;35(4):321-8. doi: 10.1097/CJI.0b013e3182562d37.
Casnici et al., Out of frame peptides from BCR/ABL alternative splicing are immunogenic in HLA A2.1 transgenic mice. Cancer Lett. Apr. 8, 2009;276(1):61-7. doi: 10.1016/j.canlet.2008.10.032. Epub Dec. 4, 2008.
Castelli et al., Mass spectrometric identification of a naturally processed melanoma peptide recognized by CD8+ cytotoxic T lymphocytes. J Exp Med. Jan. 1, 1995;181(1):363-8. doi: 10.1084/jem.181.1.363.
Castelli et al., Novel HLA-Cw8-restricted T cell epitopes derived from tyrosinase-related protein-2 and gp100 melanoma antigens. J Immunol. Feb. 1, 1999;162(3):1739-48.
Castle et al., Exploiting the mutanome for tumor vaccination. Cancer Res. Mar. 1, 2012;72(5):1081-91. doi: 10.1158/0008-5472.CAN-11-3722. Epub Jan. 11, 2012.
Cervera et al., Generation of HIV-1 Gag VLPs by transient transfection of HEK 293 suspension cell cultures using an optimized animal-derived component free medium. J Biotechnol. Jul. 20, 2013;166(4):152-65. doi: 10.1016/j.jbiotec.2013.05.001. Epub May 17, 2013.
Chandler et al., Recombinant Adeno-Associated Viral Integration and Genotoxicity: Insights from Animal Models. Hum Gene Ther. Apr. 2017;28(4):314-322. doi: 10.1089/hum.2017.009.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Chang et al., Functional characterization of the placental fusogenic membrane protein syncytin. Biol Reprod. Dec. 2004;71(6):1956-62. doi: 10.1095/biolreprod.104.033340. Epub Jul. 21, 2004.
Chao et al., Measurement of large serine integrase enzymatic characteristics in HEK293 cells reveals variability and influence on downstream reporter expression. Febs J. Nov. 2021;288(22):6410-6427. doi: 10.1111/febs.16037. Epub Jun. 23, 2021.
Chatterjee et al., A Cas9 with PAM recognition for adenine dinucleotides. Nat Commun. May 18, 2020;11(1):2474. doi: 10.1038/s41467-020-16117-8.
Chatterjee et al., Robust Genome Editing of Single-Base PAM Targets with Engineered ScCas9 Variants. bioRxiv. doi: 10.1101/620351. Posted Apr. 26, 2019.
Chen et al., DNA methylation and demethylation in mammals. J Biol Chem. May 27, 2011;286(21):18347-53. doi: 10.1074/jbc.R110.205286. Epub Mar. 24, 2011.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Chen et al., Identification of NY-ESO-1 peptide analogues capable of improved stimulation of tumor-reactive CTL. J Immunol. Jul. 15, 2000;165(2):948-55. doi: 10.4049/jimmunol.165.2.948.
Chen et al., Programmable C:G to G:C genome editing with CRISPR-Cas9-directed base excision repair proteins. Nat Commun. Mar. 2, 2021;12(1):1384. doi: 10.1038/s41467-021-21559-9.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.
Cheriyan et al., Faster protein splicing with the Nostoc punctiforme DnaE intein using non-native extein residues. J Biol Chem. Mar. 1, 2013;288(9):6202-11. doi: 10.1074/jbc.M112.433094. Epub Jan. 10, 2013.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Cho et al., Heritable gene knockout in Caenorhabditis elegans by direct injection of Cas9-sgRNA ribonucleoproteins. Genetics. Nov. 2013;195(3):1177-80. doi: 10.1534/genetics.113.155853. Epub Aug. 26, 2013.
Cho et al., Optimized peptide vaccines eliciting extensive CD8 T-cell responses with therapeutic antitumor effects. Cancer Res. Dec. 1, 2009;69(23):9012-9. doi: 10.1158/0008-5472.CAN-09-2019. Epub Nov. 10, 2009.
Choi et al., Lentivirus pre-packed with Cas9 protein for safer gene editing. Gene Ther. Jul. 2016;23(7):627-33. doi: 10.1038/gt.2016.27. Epub Apr. 7, 2016.
Choi et al., Optimization of AAV expression cassettes to improve packaging capacity and transgene expression in neurons. Mol Brain. Mar. 11, 2014;7:17. doi: 10.1186/1756-6606-7-17.
Choi et al., Precise genomic deletions using paired prime editing. Nat Biotechnol. Feb. 2022;40(2):218-226. doi: 10.1038/s41587-021-01025-z. Epub Oct. 14, 2021.
Chow et al., A web tool for the design of prime-editing guide RNAs. Nat Biomed Eng. Feb. 2021;5(2):190-194. doi: 10.1038/s41551-020-00622-8. Epub Sep. 28, 2020.
Christensen et al., Melan-A/MART1 analog peptide triggers anti-myeloma T-cells through crossreactivity with HM1.24. J Immunother. Jul.-Aug. 2009;32(6):613-21. doi: 10.1097/CJI.0b013e3181a95198.
Chylinski et al., The tracrRNA and Cas9 families of type II CRISPR-Cas immunity systems. RNA Biol. May 2013;10(5):Supplementary Material. doi: 10.4161/rna.24321. Epub Apr. 5, 2013. 12 pages.
Cideciyan, Leber congenital amaurosis due to RPE65 mutations and its treatment with gene therapy. Prog Retin Eye Res. Sep. 2010;29(5):398-427. doi: 10.1016/j.preteyeres.2010.04.002. Epub Apr. 24, 2010.
Coey, Sumoylation of thymine DNA glycosylase occurs efficiently and weakens DNA binding but does not regulate enzymatic turnover. Dissertation. 2017. 178 pages.
Cohen et al., Low LDL cholesterol in individuals of African descent resulting from frequent nonsense mutations in PCSK9. Nat Genet. Feb. 2005;37(2):161-5. doi: 10.1038/ng1509. Epub Jan. 16, 2005. Erratum in: Nat Genet. Mar. 2005;37(3):328.
Cohen et al., Sequence variations in PCSK9, low LDL, and protection against coronary heart disease. N Engl J Med. Mar. 23, 2006;354(12):1264-72. doi: 10.1056/NEJMoa054013.
Contreras-Galindo et al., Human Endogenous Retrovirus Type K (HERV-K) Particles Package and Transmit HERV-K-Related Sequences. J Virol. Jul. 2015;89(14):7187-201. doi: 10.1128/JVI.00544-15. Epub Apr. 29, 2015.
Coquin, Characterization of lentiviral vectors pseudotyped with murine syncytins and their cellular targets in vitro and in vivo. Thesis. University of Évry Val d'Essonne. Defense on Dec. 10, 2019. 238 pages.
Corcia et al., The importance of the SMN genes in the genetics of sporadic ALS. Amyotroph Lateral Scler. Oct.-Dec. 2009;10(5-6):436-40. doi: 10.3109/17482960902759162.
Correale et al., In vitro generation of human cytotoxic T lymphocytes specific for peptides derived from prostate-specific antigen. J Natl Cancer Inst. Feb. 19, 1997;89(4):293-300. doi: 10.1093/jnci/89.4.293.
Corti et al., Genetic correction of human induced pluripotent stem cells from patients with spinal muscular atrophy. Sci Transl Med. Dec. 19, 2012;4(165):165ra162. doi: 10.1126/scitranslmed.3004108.
Courtney et al., CRISPR/Cas9 DNA cleavage at SNP-derived PAM enables both in vitro and in vivo KRT12 mutation-specific targeting. Gene Ther. Jan. 2016;23(1):108-12. doi: 10.1038/gt.2015.82. Epub Aug. 20, 2015.

(56) References Cited

OTHER PUBLICATIONS

Cox et al., Identification of a peptide recognized by five melanoma-specific human cytotoxic T cell lines. Science. Apr. 29, 1994;264(5159):716-9. doi: 10.1126/science.7513441.
Cronin et al., Altering the tropism of lentiviral vectors through pseudotyping. Curr Gene Ther. Aug. 2005;5(4):387-98. doi: 10.2174/1566523054546224. Erratum in: Curr Gene Ther. Oct. 2005;5(5):531. Author Manuscript, 19 pages.
Crosti et al., Identification of novel subdominant epitopes on the carcinoembryonic antigen recognized by CD4+ T cells of lung cancer patients. J Immunol. Apr. 15, 2006;176(8):5093-9. doi: 10.4049/jimmunol.176.8.5093.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Cui et al., KPT330 improves Cas9 precision genome- and base-editing by selectively regulating mRNA nuclear export. Commun Biol. Mar. 17, 2022;5(1):237. doi: 10.1038/s42003-022-03188-0.
Dalet et al., An antigenic peptide produced by reverse splicing and double asparagine deamidation. Proc Natl Acad Sci U S A. Jul. 19, 2011;108(29):E323-31. doi: 10.1073/pnas.1101892108. Epub Jun. 13, 2011.
Damdindorj et al., A comparative analysis of constitutive promoters located in adeno-associated viral vectors. PLoS One. Aug. 29, 2014;9(8):e106472. doi: 10.1371/journal.pone.0106472.
David et al., Viral Vectors: The Road to Reducing Genotoxicity. Toxicol Sci. Feb. 2017;155(2):315-325. doi: 10.1093/toxsci/kfw220. Epub Nov. 1, 2016.
Debenedictis et al., Measuring the tolerance of the genetic code to altered codon size. Elife. Mar. 16, 2022;11:e76941. doi: 10.7554/eLife.76941.
Debenedictis et al., Multiplex suppression of four quadruplet codons via tRNA directed evolution. Nat Commun. Sep. 29, 2021;12(1):5706. doi: 10.1038/s41467-021-25948-y.
Debenedictis et al., Systematic molecular evolution enables robust biomolecule discovery. Nat Methods. Jan. 2022; 19(1):55-64. doi: 10.1038/s41592-021-01348-4. Epub Dec. 30, 2021.
Den Hollander et al., Leber congenital amaurosis: genes, proteins and disease mechanisms. Prog Retin Eye Res. Jul. 2008;27(4):391-419. doi: 10.1016/j.preteyeres.2008.05.003. Epub Jun. 1, 2008.
Depontieu et al., Identification of tumor-associated, MHC class II-restricted phosphopeptides as targets for immunotherapy. Proc Natl Acad Sci U S A. Jul. 21, 2009;106(29):12073-8. doi: 10.1073/pnas.0903852106. Epub Jul. 6, 2009.
Di Stasi et al., Review of the Results of WT1 Peptide Vaccination Strategies for Myelodysplastic Syndromes and Acute Myeloid Leukemia from Nine Different Studies. Front Immunol. Feb. 4, 2015;6:36. doi: 10.3389/fimmu.2015.00036.
Dickinson et al., A system for the continuous directed evolution of proteases rapidly reveals drug-resistance mutations. Nat Commun. Oct. 30, 2014;5:5352. doi: 10.1038/ncomms6352.
Ding et al., Gene therapy for cardiovascular disease. Journal of Shanghai University (Natural Science Edition) . 2016;3:270-9 . DOI: 10.3969/j.issn.1007-2861.2016.03.013.
Dong et al., Lentiviral Vectors for Delivery of Gene-Editing Systems Based on CRISPR/Cas: Current State and Perspectives. Viruses. Jul. 1, 2021;13(7):1288. doi: 10.3390/v13071288.
Drenth et al., Mutations in sodium-channel gene SCN9A cause a spectrum of human genetic pain disorders. J Clin Invest. Dec. 2007;117(12):3603-9. doi: 10.1172/JCI33297.
Duan et al., Immune rejection of mouse tumors expressing mutated self. Cancer Res. Apr. 15, 2009;69(8):3545-53. doi: 10.1158/0008-5472.CAN-08-2779. Epub Apr. 7, 2009. Author Manuscript. 18 pages.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Duportet et al., A platform for rapid prototyping of synthetic gene networks in mammalian cells. Nucleic Acids Res. Dec. 1, 2014;42(21):13440-51. doi: 10.1093/nar/gku1082. Epub Nov. 5, 2014.
D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
Edraki et al., A Compact, High-Accuracy Cas9 with a Dinucleotide PAM for In Vivo Genome Editing. Mol Cell. Feb. 21, 2019;73(4):714-726.e4 and Supplemental Info. doi: 10.1016/j.molcel.2018.12.003. Epub Dec. 20, 2018.
Eisenberg et al., A-to-I RNA editing—immune protector and transcriptome diversifier. Nat Rev Genet. Aug. 2018;19(8):473-490. doi: 10.1038/s41576-018-0006-1.
Ekman et al., CRISPR-Cas9-Mediated Genome Editing Increases Lifespan and Improves Motor Deficits in a Huntington's Disease Mouse Model. Mol Ther Nucleic Acids. Sep. 6, 2019;17:829-839. doi: 10.1016/j.omtn.2019.07.009. Epub Jul. 26, 2019.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Eriksen et al., Occlusion of the Ribosome Binding Site Connects the Translational Initiation Frequency, mRNA Stability and Premature Transcription Termination. Front Microbiol. Mar. 14, 2017;8:362. doi: 10.3389/fmicb.2017.00362.
Fang et al., Human strand-specific mismatch repair occurs by a bidirectional mechanism similar to that of the bacterial reaction. J Biol Chem. Jun. 5, 1993;268(16):11838-44.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Farhy-Tselnicker et al., Astrocytes, neurons, synapses: a tripartite view on cortical circuit development. Neural Dev. May 1, 2018;13(1):7. doi: 10.1186/s13064-018-0104-y.
Fehér et al., Characterization of the murine leukemia virus protease and its comparison with the human immunodeficiency virus type 1 protease. J Gen Virol. May 2006;87(Pt 5):1321-1330. doi: 10.1099/vir.0.81382-0.
Feng et al., Efficient genome editing in plants using a CRISPR/Cas system. Cell Res. Oct. 2013;23(10):1229-32. doi: 10.1038/cr.2013.114. Epub Aug. 20, 2013.
Fields et al., Gene targeting techniques for Huntington's disease. Ageing Res Rev. Sep. 2021;70:101385. doi: 10.1016/j.arr.2021.101385. Epub Jun. 5, 2021.
Fikes et al., Design of multi-epitope, analogue-based cancer vaccines. Expert Opin Biol Ther. Sep. 2003;3(6):985-93. doi: 10.1517/14712598.3.6.985.
Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.
Fitzgerald et al., Effect of an RNA interference drug on the synthesis of proprotein convertase subtilisin/kexin type 9 (PCSK9) and the concentration of serum LDL cholesterol in healthy volunteers: a randomised, single-blind, placebo-controlled, phase 1 trial. Lancet. Jan. 4, 2014;383(9911):60-68. doi: 10.1016/S0140-6736(13)61914-5. Epub Oct. 3, 2013.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Supplementary Information. 67 pages.
Fontana et al., Rabies virus-like particles expressed in HEK293 cells. Vaccine. May 19, 2014;32(24):2799-804. doi: 10.1016/j.vaccine.2014.02.031. Epub Mar. 12, 2014.

(56) References Cited

OTHER PUBLICATIONS

Fonteneau et al., The Tumor Antigen NY-ESO-1 Mediates Direct Recognition of Melanoma Cells by CD4+ T Cells after Intercellular Antigen Transfer. J Immunol. Jan. 1, 2016;196(1):64-71. doi: 10.4049/jimmunol.1402664. Epub Nov. 25, 2015.
Fourcade et al., PD-1 and Tim-3 regulate the expansion of tumor antigen-specific $CD8^+$ T cells induced by melanoma vaccines. Cancer Res. Feb. 15, 2014;74(4):1045-55. doi: 10.1158/0008-5472. CAN-13-2908. Epub Dec. 16, 2013.
Fridman et al., An efficient T-cell epitope discovery strategy using in silico prediction and the iTopia assay platform. Oncoimmunology. Nov. 1, 2012;1(8):1258-1270. doi: 10.4161/onci.21355.
Friedman, Greedy function approximation: A gradient boosting machine. Ann. Statist. Oct. 2001;29(5):1189-232. doi: 10.1214/aos/1013203451.
Fu et al., Targeted genome editing in human cells using CRISPR/Cas nucleases and truncated guide RNAs. Methods Enzymol. 2014;546:21-45. doi: 10.1016/B978-0-12-801185-0.00002-7.
Fujiki et al., Identification and characterization of a WT1 (Wilms Tumor Gene) protein-derived HLA-DRB1*0405-restricted 16-mer helper peptide that promotes the induction and activation of WT1-specific cytotoxic T lymphocytes. J Immunother. Apr. 2007;30(3):282-93. doi: 10.1097/01.cji.0000211337.91513.94.
Gaidukov et al., A multi-landing pad DNA integration platform for mammalian cell engineering. Nucleic Acids Res. May 4, 2018;46(8):4072-4086. doi: 10.1093/nar/gky216.
Gao et al., Delineation of the Exact Transcription Termination Signal for Type 3 Polymerase III. Mol Ther Nucleic Acids. Mar. 2, 2018;10:36-44. doi: 10.1016/j.omtn.2017.11.006. Epub Nov. 21, 2017.
Gao et al., Genomic and Transcriptomic Analyses of Prime Editing Guide RNA-Independent Off-Target Effects by Prime Editors. Crispr J. 2022;5(2):276-93. doi: 10.1089/crispr.2021.0080.
Garnier et al., WW domains and retrovirus budding. Nature. Jun. 27, 1996;381(6585):744-5. doi: 10.1038/381744a0.
Gaudelli et al., Directed evolution of adenine base editors with increased activity and therapeutic application. Nat Biotechnol. Jul. 2020;38(7):892-900. doi: 10.1038/s41587-020-0491-6. Epub Apr. 13, 2020.
Gee et al., Extracellular nanovesicles for packaging of CRISPR-Cas9 protein and sgRNA to induce therapeutic exon skipping. Nat Commun. Mar. 13, 2020;11(1):1334. doi: 10.1038/s41467-020-14957-y.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
GenBank Access No. BAP64357. Aug. 1, 2013. 1 page.
GenBank Accession No. AAH57574.1 2009. 2 pages.
Genbank Submission; NIH/NCBI, Accession No. NC_000001.11. Gregory et al., Jun. 6, 2016. 3 pages.
Genbank Submission; NIH/NCBI, Accession No. NM_206933.2. Khalaileh et al., Sep. 16, 2018. 12 pages.
Genbank Submission; NIH/NCBI, Accession No. NP_060228.2. Bi et al., Dec. 21, 2005. 1 page.
Genbank Submission; NIH/NCBI, Accession No. NP_062826.2. Bokar et al., Sep. 18, 2004. 2 pages.
Genbank Submission; NIH/NCBI, Accession No. NP_066012.1. Ota et al., Apr. 3, 2005. 2 pages.
Genbank Submission; NIH/NCBI, Accession No. NP_996816.2. Fu et al., Sep. 22, 2019. 9 pages.
Genbank Submission; NIH/NCBI, Accession No. WP_042518169.1. No Author, Feb. 10, 2015. 1 page.
Geng et al., In vitro studies of DNA mismatch repair proteins. Anal Biochem. Jun. 15, 2011;413(2):179-84. doi: 10.1016/j.ab.2011.02.017. Epub Feb. 15, 2011.
Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.
Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.
Geurts et al., Evaluating CRISPR-based prime editing for cancer modeling and CFTR repair in organoids. Life Sci Alliance. Aug. 9, 2021;4(10):e202000940. doi: 10.26508/lsa.202000940.
Geynisman et al., A randomized pilot phase I study of modified carcinoembryonic antigen (CEA) peptide (CAP1-6D)/montanide/GM-CSF-vaccine in patients with pancreatic adenocarcinoma. J Immunother Cancer. Jun. 27, 2013;1:8. doi: 10.1186/2051-1426-1-8.
Ghosh et al., Synapsis in phage Bxb1 integration: selection mechanism for the correct pair of recombination sites. J Mol Biol. Jun. 3, 2005;349(2):331-48. doi: 10.1016/j.jmb.2005.03.043. Epub Apr. 7, 2005.
Giannoukos et al., UDiTaS™, a genome editing detection method for indels and genome rearrangements. BMC Genomics. Mar. 21, 2018;19(1):212. doi: 10.1186/s12864-018-4561-9.
Girard-Gagnepain et al., Baboon envelope pseudotyped LVs outperform VSV-G-LVs for gene transfer into early-cytokine-stimulated and resting HSCs. Blood. Aug. 21, 2014;124(8):1221-31. doi: 10.1182/blood-2014-02-558163. Epub Jun. 20, 2014.
Godefroy et al., Identification of two Melan-A CD4+ T cell epitopes presented by frequently expressed MHC class II alleles. Clin Immunol. Oct. 2006;121(1):54-62. doi: 10.1016/j.clim.2006.05.007. Epub Jun. 30, 2006.
Golczak et al., Importance of membrane structural integrity for RPE65 retinoid isomerization activity. J Biol Chem. Mar. 26, 2010;285(13):9667-9682. doi: 10.1074/jbc.M109.063941. Epub Jan. 25, 2010.
Graff-Dubois et al., Generation of CTL recognizing an HLA-A*0201-restricted epitope shared by MAGE-A1, -A2, -A3, -A4, -A6, -A10, and -A12 tumor antigens: implication in a broad-spectrum tumor immunotherapy. J Immunol. Jul. 1, 2002;169(1):575-80. doi: 10.4049/jimmunol.169.1.575.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.
Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.
Gross et al., High vaccination efficiency of low-affinity epitopes in antitumor immunotherapy. J Clin Invest. Feb. 2004;113(3):425-33. doi: 10.1172/JCI19418.
Gueneau et al., Structure of the MutLα C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.
Guerrette et al., The interaction of the human MutL homologues in hereditary nonpolyposis colon cancer. J Biol Chem. Mar. 5, 1999;274(10):6336-41. doi: 10.1074/jbc.274.10.6336.
Guevara-Patiño et al., Optimization of a self antigen for presentation of multiple epitopes in cancer immunity. J Clin Invest. May 2006;116(5):1382-90. doi: 10.1172/JCI25591. Epub Apr. 13, 2006.
Guibinga et al., Cell surface heparan sulfate is a receptor for attachment of envelope protein-free retrovirus-like particles and VSV-G pseudotyped MLV-derived retrovirus vectors to target cells. Mol Ther. May 2002;5(5 Pt 1):538-46. doi: 10.1006/mthe.2002.0578.
Gulley et al., Combining a Recombinant Cancer Vaccine with Standard Definitive Radiotherapy in Patients with Localized Prostate Cancer. Clin Cancer Res. May 2, 2005;11(9):3353-62. doi: 10.1158/1078-0432.CCR-04-2062.
Guo et al., Direct recognition and lysis of leukemia cells by WT1-specific CD4+ T lymphocytes in an HLA class II-restricted manner. Blood. Aug. 15, 2005;106(4):1415-8. doi: 10.1182/blood-2005-01-0413. Epub Apr. 21, 2005.
Guo et al., Precision modeling of mitochondrial diseases in zebrafish via DdCBE-mediated mtDNA base editing. Cell Discov. Sep. 3, 2021;7(1):78. doi: 10.1038/s41421-021-00307-9.

(56) References Cited

OTHER PUBLICATIONS

Gupta et al., Mechanism of mismatch recognition revealed by human MutSß bound to unpaired DNA loops. Nat Struct Mol Biol. Dec. 18, 2011;19(1):72-8. doi: 10.1038/nsmb.2175.
Gusel'Nikova et al., NeuN As a Neuronal Nuclear Antigen and Neuron Differentiation Marker. Acta Naturae. Apr.-Jun. 2015;7(2):42-7.
Gutkin et al., RNA delivery with a human virus-like particle. Nat Biotechnol. Dec. 2021;39(12):1514-1515. doi: 10.1038/s41587-021-01124-x.
Habib et al., Comprehensive analysis of prime editing outcomes in human embryonic stem cells. Nucleic Acids Res. Jan. 25, 2022;50(2):1187-1197. doi: 10.1093/nar/gkab1295.
Haeussler et al., Genome Editing with CRISPR-Cas9: Can It Get Any Better? J Genet Genomics. May 20, 2016;43(5):239-50. doi: 10.1016/j.jgg.2016.04.008. Epub Apr. 24, 2016. Author Manuscript. 22 pages.
Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.
Hamilton et al., Knocking out barriers to engineered cell activity. Science. Feb. 28, 2020;367(6481):976-977. doi: 10.1126/science.aba9844. Epub Feb. 6, 2020.
Hamilton et al., Targeted delivery of CRISPR-Cas9 and transgenes enables complex immune cell engineering. Cell Rep. Jun. 1, 2021;35(9):109207 and Suppl Info. doi: 10.1016/j.celrep.2021.109207.
Hamilton et al., Targeted delivery of CRISPR-Cas9 and transgenes enables complex immune cell engineering. Cell Rep. Jun. 1, 2021;35(9):109207. doi: 10.1016/j.celrep.2021.109207.
Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.
Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.
Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.
Heins et al., Designing Automated, High-throughput, Continuous Cell Growth Experiments Using eVOLVER. J Vis Exp. May 19, 2019;(147):10.3791/59652. doi: 10.3791/59652.
Heintze et al., A CRISPR CASe for high-throughput silencing. Front Genet. Oct. 7, 2013;4:193. doi: 10.3389/fgene.2013.00193.
Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.
Herbst-Kralovetz et al., Norwalk virus-like particles as vaccines. Expert Rev Vaccines. Mar. 2010;9(3):299-307. doi: 10.1586/erv.09.163. Author Manuscript, 16 pages.
Heyer et al., Regulation of homologous recombination in eukaryotes. Annu Rev Genet. 2010;44:113-39. doi: 10.1146/annurev-genet-051710-150955. Author Manuscript. 33 pages.
Hirohashi et al., An HLA-A24-restricted cytotoxic T lymphocyte epitope of a tumor-associated protein, survivin. Clin Cancer Res. Jun. 2002;8(6):1731-9.
Hizi et al., Retroviral reverse transcriptases (other than those of HIV-1 and murine leukemia virus): a comparison of their molecular and biochemical properties. Virus Res. Jun. 2008;134(1-2):203-20. doi: 10.1016/j.virusres.2007.12.008. Epub Mar. 3, 2008.
Hong et al., Novel recombinant hepatitis B virus vectors efficiently deliver protein and RNA encoding genes into primary hepatocytes. J Virol. Jun. 2013;87(12):6615-24. doi: 10.1128/JVI.03328-12. Epub Apr. 3, 2013.
Hooper et al., The C679X mutation in PCSK9 is present and lowers blood cholesterol in a Southern African population. Atherosclerosis. Aug. 2007;193(2):445-8. doi: 10.1016/j.atherosclerosis.2006.08.039. Epub Sep. 20, 2006.
Houck-Loomis et al., An equilibrium-dependent retroviral mRNA switch regulates translational recoding. Nature. Nov. 27, 2011;480(7378):561-4. doi: 10.1038/nature10657.
Houghton et al., Immunological validation of the EpitOptimizer program for streamlined design of heteroclitic epitopes. Vaccine. Jul. 20, 2007;25(29):5330-42. doi: 10.1016/j.vaccine.2007.05.008. Epub Jun. 4, 2007.
Houseley et al., The many pathways of RNA degradation. Cell. Feb. 20, 2009;136(4):763-76. doi: 10.1016/j.cell.2009.01.019.
Hu et al., Discovery and engineering of small SlugCas9 with broad targeting range and high specificity and activity. Nucleic Acids Res. Apr. 19, 2021;49(7):4008-4019. doi: 10.1093/nar/gkab148.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Humbel et al., Maximizing lentiviral vector gene transfer in the CNS. Gene Ther. Feb. 2021;28(1-2):75-88. doi: 10.1038/s41434-020-0172-6. Epub Jul. 6, 2020. Erratum in: Gene Ther. May 2022;29(5):312.
Hussman et al., Mapping the genetic landscape of DNA double-strand break repair. Cell. Oct. 28, 2021;184(22):5653-5669.e25. doi: 10.1016/j.cell.2021.10.002. Epub Oct. 20, 2021.
Hwang et al., Heritable and precise zebrafish genome editing using a CRISPR-Cas system. PLoS One. Jul. 9, 2013;8(7):e68708. doi: 10.1371/journal.pone.0068708.
Hwang et al., PE-Designer and PE-Analyzer: web-based design and analysis tools for CRISPR prime editing. Nucleic Acids Res. Jul. 2, 2021;49(W1):W499-W504. doi: 10.1093/nar/gkab319.
Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9.2677.
Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.
Indikova et al., Highly efficient 'hit-and-run' genome editing with unconcentrated lentivectors carrying Vpr.Prot.Cas9 protein produced from RRE-containing transcripts. Nucleic Acids Res. Aug. 20, 2020;48(14):8178-8187. doi: 10.1093/nar/gkaa561.
Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.
Iyer et al., DNA mismatch repair: functions and mechanisms. Chem Rev. Feb. 2006;106(2):302-23. doi: 10.1021/cr0404794.
Jacobs et al., DNA glycosylases: in DNA repair and beyond. Chromosoma. Feb. 2012;121(1):1-20. doi: 10.1007/s00412-011-0347-4. Epub Nov. 3, 2011. 20 pages.
Jakimo et al., A Cas9 with Complete PAM Recognition for Adenine Dinucleotides. bioRxiv preprint. Sep. 27, 2018. doi.org/10.1101/429654. 29 pages.
Jalaguier et al., Efficient production of HIV-1 virus-like particles from a mammalian expression vector requires the N-terminal capsid domain. PLoS One. 2011;6(11):e28314. doi: 10.1371/journal.pone.0028314. Epub Nov. 30, 2011.
Jang et al., Application of prime editing to the correction of mutations and phenotypes in adult mice with liver and eye diseases. Nat Biomed Eng. Feb. 2022;6(2):181-194. doi: 10.1038/s41551-021-00788-9. Epub Aug. 26, 2021.
Jang et al., High-purity production and precise editing of DNA base editing ribonucleoproteins. Sci Adv. Aug. 27, 2021;7(35):eabg2661. doi: 10.1126/sciadv.abg2661.

(56) References Cited

OTHER PUBLICATIONS

Jaramillo et al., Identification of HLA-A3-restricted CD8+ T cell epitopes derived from mammaglobin-A, a tumor-associated antigen of human breast cancer. Int J Cancer. Dec. 10, 2002;102(5):499-506. doi: 10.1002/ijc.10736.
Jeong et al., Current Status and Challenges of DNA Base Editing Tools. Mol Ther. Sep. 2, 2020;28(9):1938-1952. doi: 10.1016/j.ymthe.2020.07.021. Epub Jul. 23, 2020.
Jiang et al., Deletion and replacement of long genomic sequences using prime editing. Nat Biotechnol. Feb. 2022;40(2):227-234. doi: 10.1038/s41587-021-01026-y. Epub Oct. 14, 2021.
Jiao et al., Random-PE: an efficient integration of random sequences into mammalian genome by prime editing. Mol Biomed. Nov. 18, 2021;2(1):36. doi: 10.1186/s43556-021-00057-w.
Jin et al., Genome-wide specificity of prime editors in plants. Nat Biotechnol. Oct. 2021;39(10):1292-1299. doi: 10.1038/s41587-021-00891-x. Epub Apr. 15, 2021.
Jinek et al., A programmable dual-RNA-guided DNA endonuclease in adaptive bacterial immunity. Science. Aug. 17, 2012;337(6096):Supplementary Material. doi: 10.1126/science.1225829. Epub Jun. 28, 2012. 37 pages.
Jo et al., Therapeutic adenine base editing corrects nonsense mutation and improves visual function in a mouse model of Leber congenital amaurosis. bioRxiv preprint. Jan. 8, 2021. doi: 10.1101/2021.01.07.425822. 19 pages.
Joglekar et al., Pseudotyped Lentiviral Vectors: One Vector, Many Guises. Hum Gene Ther Methods. Dec. 2017;28(6):291-301. doi: 10.1089/hgtb.2017.084. Epub Sep. 4, 2017.
Johnson et al., Mass spectrometry analysis reveals differences in the host cell protein species found in pseudotyped lentiviral vectors. Biologicals. Mar. 2018;52:59-66. doi: 10.1016/j.biologicals.2017.12.005. Epub Feb. 1, 2018.
Johnson, Origins and evolutionary consequences of ancient endogenous retroviruses. Nat Rev Microbiol. Jun. 2019;17(6):355-370. doi: 10.1038/s41579-019-0189-2.
Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.
Kaczmarczyk et al., Protein delivery using engineered virus-like particles. Proc Natl Acad Sci US A. Oct. 11, 2011;108(41):16998-7003. doi: 10.1073/pnas.1101874108. Epub Sep. 2, 20116.
Kadyrov et al., Endonucleolytic function of MutLalpha in human mismatch repair. Cell. Jul. 28, 2006;126(2):297-308. doi: 10.1016/j.cell.2006.05.039.
Kameya et al., Mfrp, a gene encoding a frizzled related protein, is mutated in the mouse retinal degeneration 6. Hum Mol Genet. Aug. 1, 2002;11(16):1879-86. doi: 10.1093/hmg/11.16.1879.
Kang et al., Chimeric rabies virus-like particles containing membrane-anchored GM-CSF enhances the immune response against rabies virus. Viruses. Mar. 11, 2015;7(3):1134-52. doi: 10.3390/v7031134.
Kang et al., Chloroplast and mitochondrial DNA editing in plants. Nat Plants. Jul. 2021;7(7):899-905. doi: 10.1038/s41477-021-00943-9. Epub Jul. 1, 2021.
Kang et al., Identification of a tyrosinase epitope recognized by HLA-A24-restricted, tumor- infiltrating lymphocytes. J Immunol. Aug. 1, 1995;155(3):1343-8.
Karbach et al., Long-term complete remission following radiosurgery and immunotherapy in a melanoma patient with brain metastasis: immunologic correlates. Cancer Immunol Res. May 2014;2(5):404-9. doi: 10.1158/2326-6066.CIR-13-0200. Epub Feb. 5, 2014.
Karimian et al., CRISPR/Cas9 novel therapeutic road for the treatment of neurodegenerative diseases. Life Sci. Oct. 15, 2020;259:118165. doi: 10.1016/j.lfs.2020.118165. Epub Jul. 29, 2020.
Karvelis et al., PAM recognition by miniature CRISPR-Cas12f nucleases triggers programmable double-stranded DNA target cleavage. Nucleic Acids Res. May 21, 2020;48(9):5016-5023. doi: 10.1093/nar/gkaa208.
Kato et al., A lentiviral strategy for highly efficient retrograde gene transfer by pseudotyping with fusion envelope glycoprotein. Hum Gene Ther. Feb. 2011;22(2):197-206. doi: 10.1089/hum.2009.179. Epub Jan. 27, 2011.
Kato et al., Selective neural pathway targeting reveals key roles of thalamostriatal projection in the control of visual discrimination. J Neurosci. Nov. 23, 2011;31(47):17169-79. doi: 10.1523/JNEUROSCI.4005-11.2011.
Katoh et al., Exploitation of the interaction of measles virus fusogenic envelope proteins with the surface receptor CD46 on human cells for microcell-mediated chromosome transfer. BMC Biotechnol. May 6, 2010;10:37. doi: 10.1186/1472-6750-10-37.
Kawakami et al., Identification of a human melanoma antigen recognized by tumor-infiltrating lymphocytes associated with in vivo tumor rejection. Proc Natl Acad Sci U S A. Jul. 5, 1994;91(14):6458-62. doi: 10.1073/pnas.91.14.6458.
Kawakami et al., Identification of new melanoma epitopes on melanosomal proteins recognized by tumor infiltrating T lymphocytes restricted by HLA-A1, -A2, and -A3 alleles. J Immunol. Dec. 15, 1998;161(12):6985-92.
Kawakami et al., Identification of the immunodominant peptides of the MART-1 human melanoma antigen recognized by the majority of HLA-A2-restricted tumor infiltrating lymphocytes. J Exp Med. Jul. 1, 1994;180(1):347-52. doi: 10.1084/jem.180.1.347.
Kawakami et al., Recognition of multiple epitopes in the human melanoma antigen gp100 by tumor-infiltrating T lymphocytes associated with in vivo tumor regression. J Immunol. Apr. 15, 1995;154(8):3961-8.
Kawashima et al., Identification of gp100-derived, melanoma-specific cytotoxic T-lymphocyte epitopes restricted by HLA-A3 supertype molecules by primary in vitro immunization with peptide-pulsed dendritic cells. Int J Cancer. Nov. 9, 1998;78(4):518-24. doi: 10.1002/(sici)1097-0215(19981109)78:4<518::aid-ijc20>3.0.co;2-0.
Kawashima et al., Identification of HLA-A3-restricted cytotoxic T lymphocyte epitopes from carcinoembryonic antigen and HER-2/neu by primary in vitro immunization with peptide-pulsed dendritic cells. Cancer Res. Jan. 15, 1999;59(2):431-5.
Kawashima et al., The multi-epitope approach for immunotherapy for cancer: identification of several CTL epitopes from various tumor-associated antigens expressed on solid epithelial tumors. Hum Immunol. Jan. 1998;59(1):1-14. doi: 10.1016/s0198-8859(97)00255-3.
Kazemian et al., Lipid-Nanoparticle-Based Delivery of CRISPR/Cas9 Genome-Editing Components. Mol Pharm. Jun. 6, 2022;19(6):1669-1686. doi: 10.1021/acs.molpharmaceut.1c00916. Epub May 20, 2022.
Kemmler et al., Elevated tumor-associated antigen expression suppresses variant peptide vaccine responses. J Immunol. Nov. 1, 2011;187(9):4431-9. doi: 10.4049/jimmunol.1101555. Epub Sep. 21, 2011.
Kim et al., AAV-deliverable hypercompact adenine base editors based on transposase B guided by engineered RNA. Research Square. Apr. 12, 2022. DOI: 10.21203/r9.3.rs-1326630/v1. Retrieved from https://www.researchsquare.com/articleIrs-1326630/v1 on Aug. 1, 2023. 20 pages.
Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.
Kim et al., Unbiased investigation of specificities of prime editing systems in human cells. Nucleic Acids Res. Oct. 9, 2020;48(18):10576-10589. doi: 10.1093/nar/gkaa764.
Kirshenboim et al., Expression and characterization of a novel reverse transcriptase of the LTR retrotransposon Tf1. Virology. Sep. 30, 2007;366(2):263-76. doi: 10.1016/j.virol.2007.04.002. Epub May 23, 2007.
Kittlesen et al., Human melanoma patients recognize an HLA-A1-restricted CTL epitope from tyrosinase containing two cysteine residues: implications for tumor vaccine development. J Immunol. Mar. 1, 1998;160(5):2099-106. Erratum in: J Immunol Mar. 1, 1999;162(5):3106. Shabanowitz JA [corrected to Shabanowitz J].

(56) References Cited

OTHER PUBLICATIONS

Kizer et al., Application of functional genomics to pathway optimization for increased isoprenoid production. Appl Environ Microbiol. May 2008;74(10):3229-41. doi: 10.1128/AEM.02750-07. Epub Mar. 14, 2008.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015. Author Manuscript, 14 pages.
Kneissl et al., Measles virus glycoprotein-based lentiviral targeting vectors that avoid neutralizing antibodies. PLoS One. 2012;7(10):e46667. doi: 10.1371/journal.pone.0046667. Epub Oct. 10, 2012.
Knipping et al., Disruption of HIV-1 co-receptors CCR5 and CXCR4 in primary human T cells and hematopoietic stem and progenitor cells using base editing. Mol Ther. Jan. 5, 2022;30(1):130-144. doi: 10.1016/j.ymthe.2021.10.026. Epub Nov. 2, 2021.
Knott et al., CRISPR-Cas guides the future of genetic engineering. Science. Aug. 31, 2018;361(6405):866-869. doi: 10.1126/science.aat5011.
Kobayashi et al., CD4+ T cells from peripheral blood of a melanoma patient recognize peptides derived from nonmutated tyrosinase. Cancer Res. Jan. 15, 1998;58(2):296-301.
Kobayashi et al., Identification of an antigenic epitope for helper T lymphocytes from carcinoembryonic antigen. Clin Cancer Res. Oct. 2002;8(10):3219-25.
Kobayashi et al., Identification of helper T-cell epitopes that encompass or lie proximal to cytotoxic T-cell epitopes in the gp100 melanoma tumor antigen. Cancer Res. Oct. 15, 2001;61(20):7577-84.
Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.
Kotterman et al., Engineering adeno-associated viruses for clinical gene therapy. Nat Rev Genet. Jul. 2014;15(7):445-51. doi: 10.1038/nrg3742. Epub May 20, 2014.
Ku et al., Nucleic Acid Aptamers: An Emerging Tool for Biotechnology and Biomedical Sensing. Sensors (Basel). Jul. 6, 2015;15(7):16281-313. doi: 10.3390/s150716281.
Kuan et al., A systematic evaluation of nucleotide properties for CRISPR sgRNA design. BMC Bioinformatics. Jun. 6, 2017;18(1):297. doi: 10.1186/s12859-017-1697-6.
Kuang et al., Advances in base editing with an emphasis on an AAV-based strategy. Methods. Oct. 2021;194:56-64. doi: 10.1016/j.ymeth.2021.03.015. Epub Mar. 25, 2021.
Kueh et al., The new editor-targeted genome engineering in the absence of homology-directed repair. Cell Death Discov. Jun. 13, 2016;2:16042. doi: 10.1038/cddiscovery.2016.42.
Kulcsár et al., Blackjack mutations improve the on-target activities of increased fidelity variants of SpCas9 with 5'G-extended sgRNAs. Nat Commun. Mar. 6, 2020;11(1):1223. doi: 10.1038/s41467-020-15021-5.
Kunkel et al., DNA mismatch repair. Annu Rev Biochem. 2005;74:681-710. doi: 10.1146/annurev.biochem.74.082803.133243.
Kurt et al., CRISPR C-to-G base editors for inducing targeted DNA transversions in human cells. Nat Biotechnol. Jan. 2021;39(1):41-46. doi: 10.1038/s41587-020-0609-x. Epub Jul. 20, 2020.
Kushnir et al., Virus-like particles as a highly efficient vaccine platform: diversity of targets and production systems and advances in clinical development. Vaccine. Dec. 17, 2012;31(1):58-83. doi: 10.1016/j.vaccine.2012.10.083. Epub Nov. 6, 2012.
Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.
Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.
Kwon et al., Precision targeting tumor cells using cancer-specific InDel mutations with CRISPR-Cas9. Proc Natl Acad Sci U S A. Mar. 1, 2022;119(9):e2103532119. doi: 10.1073/pnas.2103532119.
Lahue et al., DNA mismatch correction in a defined system. Science. Jul. 14, 1989;245(4914):160-4. doi: 10.1126/science.2665076.
Lally et al., Unmasking cryptic epitopes after loss of immunodominant tumor antigen expression through epitope spreading. Int J Cancer. Sep. 2001;93(6):841-7. doi: 10.1002/ijc.1420.
Langer et al., Chemical and Physical Structure of Polymers as Carriers for Controlled Release of Bioactive Agents: A Review. J Macromol Sci, Part C, 1983;23(1):61-126. doi: 10.1080/07366578308079439.
Lapointe et al., Retrovirally transduced human dendritic cells can generate T cells recognizing multiple MHC class I and class II epitopes from the melanoma antigen glycoprotein 100. J Immunol. Oct. 15, 2001;167(8):4758-64. doi: 10.4049/jimmunol.167.8.4758.
Larrieu et al., A HLA-Cw*0701 restricted Melan-A/MART1 epitope presented by melanoma tumor cells to CD8+ tumor infiltrating lymphocytes. Cancer Immunol Immunother. May 2008;57(5):745-52. doi: 10.1007/s00262-007-0436-7. Epub Dec. 21, 2007.
Latham et al., Formation of wild-type and chimeric influenza virus-like particles following simultaneous expression of only four structural proteins. J Virol. Jul. 2001;75(13):6154-65. doi: 10.1128/JVI.75.13.6154-6165.2001.
Lazzarotto et al., CHANGE-seq reveals genetic and epigenetic effects on CRISPR-Cas9 genome-wide activity. Nat Biotechnol. Nov. 2020;38(11):1317-1327. doi: 10.1038/s41587-020-0555-7. Epub Jun. 15, 2020.
Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.
Leach et al., Mutations of a mutS homolog in hereditary nonpolyposis colorectal cancer. Cell. Dec. 17, 1993;75(6):1215-25. doi: 10.1016/0092-8674(93)90330-s.
Lebar et al., A tunable orthogonal coiled-coil interaction toolbox for engineering mammalian cells. Nat Chem Biol. May 2020;16(5):513-519. doi: 10.1038/s41589-019-0443-y. Epub Jan. 6, 2020.
Lee et al., Mitochondrial DNA editing in mice with DddA-TALE fusion deaminases. Nat Commun. Feb. 19, 2021;12(1):1190. doi: 10.1038/s41467-021-21464-1.
Lee et al., Reconstitution of an infectious human endogenous retrovirus. PLoS Pathog. Jan. 2007;3(1):e10. doi: 10.1371/journal.ppat.0030010.
Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773. 13 pages.
Leenay et al., Identifying and Visualizing Functional PAM Diversity across CRISPR-Cas Systems. Mol Cell. Apr. 7, 2016;62(1):137-47. doi: 10.1016/j.molcel.2016.02.031. Epub Mar. 31, 2016.
Lefebvre et al., Identification and characterization of a spinal muscular atrophy-determining gene. Cell. Jan. 13, 1995;80(1):155-65. doi: 10.1016/0092-8674(95)90460-3.
Leibowitz et al., Chromothripsis as an on-target consequence of CRISPR-Cas9 genome editing. Nat Genet. Jun. 2021;53(6):895-905. doi: 10.1038/s41588-021-00838-7. Epub Apr. 12, 2021.
Leibundgut-Landmann et al., Mini-review: Specificity and expression of CIITA, the master regulator of MHC class II genes. Eur J Immunol. Jun. 2004;34(6):1513-25. doi: 10.1002/eji.200424964.
Lennerz et al., The response of autologous T cells to a human melanoma is dominated by mutated neoantigens. Proc Natl Acad Sci U S A. Nov. 1, 2005;102(44):16013-8. doi: 10.1073/pnas.0500090102. Epub Oct. 24, 2005.
Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.
Li et al., A dominant-negative form of mouse SOX2 induces trophectoderm differentiation and progressive polyploidy in mouse embryonic stem cells. J Biol Chem. Jul. 6, 2007;282(27):19481-92. doi: 10.1074/jbc.M702056200. Epub May 15, 2007.

(56) References Cited

OTHER PUBLICATIONS

Li et al., Base-Resolution Mapping Reveals Distinct m1A Methylome in Nuclear- and Mitochondrial-Encoded Transcripts. Mol Cell. Dec. 7, 2017;68(5):993-1005.e9. doi: 10.1016/j.molcel.2017.10.019. Epub Nov. 5, 2017.
Li et al., Expression and self-assembly of empty virus-like particles of hepatitis E virus. J Virol. Oct. 1997;71(10):7207-13. doi: 10.1128/JVI.71.10.7207-7213.1997.
Li et al., The Importance of Glycans of Viral and Host Proteins in Enveloped Virus Infection. Front Immunol. Apr. 29, 2021;12:638573. doi: 10.3389/fimmu.2021.638573.
Lim et al., Nuclear and mitochondrial DNA editing in human cells with zinc finger deaminases. Nat Commun. Jan. 18, 2022;13(1):366. doi: 10.1038/s41467-022-27962-0.
Lim et al., Specific insertions of zinc finger domains into Gag-Pol yield engineered retroviral vectors with selective integration properties. Proc Natl Acad Sci U S A. Jul. 13, 2010;107(28):12475-80. doi: 10.1073/pnas.1001402107. Epub Jun. 28, 2010.
Lin et al., [Construction and evaluation of DnaB split intein high expression vector and a six amino acids cyclic peptide library]. Sheng Wu Gong Cheng Xue Bao. Nov. 2008;24(11):1924-30. Chinese.
Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.
Lin et al., CRISPR base editor treats premature-aging syndrome. Signal Transduct Target Ther. Apr. 16, 2021;6(1):158. doi: 10.1038/s41392-021-00576-6.
Lin et al., HLA-DPB1*05: 01-restricted WT1332-specific TCR-transduced CD4+ T lymphocytes display a helper activity for WT1-specific CTL induction and a cytotoxicity against leukemia cells. J Immunother. Apr. 2013;36(3):159-70. doi: 10.1097/CJI.0b013e3182873581.
Lin et al., Modeling a cataract disorder in mice with prime editing. Mol Ther Nucleic Acids. Jul. 2, 2021;25:494-501. doi: 10.1016/j.omtn.2021.06.020.
Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.
Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.
Longsworth, Expanding the Enzymatic Activity of the Programmable Endonuclease Cas9 in Zebrafish. Thesis. Rice University. Houston, TX. May 17, 2019. 41 pages.
Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.
Loughrey et al., Non-liver mRNA Delivery. Acc Chem Res. Jan. 4, 2022;55(1):13-23. doi: 10.1021/acs.accounts.1c00601. Epub Dec. 3, 2021.
Lu et al., Lentiviral Capsid-Mediated *Streptococcus pyogenes* Cas9 Ribonucleoprotein Delivery for Efficient and Safe Multiplex Genome Editing. Crispr J. Dec. 2021;4(6):914-928. doi: 10.1089/crispr.2020.0106. Epub Mar. 16, 2021.
Lu, Periodic Chart of Amino Acid PDF. Accessed on the internet at https://figshare.com/articles/figure/periodic_chart_of_amino_acid_pdf/3445001/1. Posted Jun. 21, 2016. www.bachem.com. 1 page.
Ludwig et al., Virus-like particles-universal molecular toolboxes. Curr Opin Biotechnol. Dec. 2007;18(6):537-45. doi: 10.1016/j.copbio.2007.10.013.
Lueck et al., Engineered transfer RNAs for suppression of premature termination codons. Nat Commun. Feb. 18, 2019;10(1):822. doi: 10.1038/s41467-019-08329-4.
Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.
Lupetti et al., Translation of a retained intron in tyrosinase-related protein (TRP) 2 mRNA generates a new cytotoxic T lymphocyte (CTL)-defined and shared human melanoma antigen not expressed in normal cells of the melanocytic lineage. J Exp Med. Sep. 21, 1998;188(6): 1005-16. doi: 10.1084/jem.188.6.1005.
Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.
Lyu et al., Adenine Base Editor Ribonucleoproteins Delivered by Lentivirus-Like Particles Show High On-Target Base Editing and Undetectable RNA Off-Target Activities. CRISPR J. Feb. 2021;4(1):69-81. doi: 10.1089/crispr.2020.0095.
Lyu et al., Delivering Cas9/sgRNA ribonucleoprotein (RNP) by lentiviral capsid-based bionanoparticles for efficient 'hit-and-run' genome editing. Nucleic Acids Res. Sep. 26, 2019;47(17):e99. doi: 10.1093/nar/gkz605.
Lyu et al., Virus-Like Particle Mediated CRISPR/Cas9 Delivery for Efficient and Safe Genome Editing. Life (Basel). Dec. 21, 2020;10(12):366. doi: 10.3390/life10120366.
Ma et al., Pol III Promoters to Express Small RNAs: Delineation of Transcription Initiation. Mol Ther Nucleic Acids. May 6, 2014;3(5):e161. doi: 10.1038/mtna.2014.12.
Macfadden et al., Mechanism and structural diversity of exoribonuclease-resistant RNA structures in flaviviral RNAs. Nat Commun. Jan. 9, 2018;9(1):119. doi: 10.1038/s41467-017-02604-y.
Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.
Maetzig et al., Retroviral protein transfer: falling apart to make an impact. Curr Gene Ther. Oct. 2012;12(5):389-409. doi: 10.2174/156652312802762581.
Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.
Mandic et al., The alternative open reading frame of LAGE-1 gives rise to multiple promiscuous HLA-DR-restricted epitopes recognized by T-helper 1-type tumor-reactive CD4+ T cells. Cancer Res. Oct. 1, 2003;63(19):6506-15.
Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.
Mangeot et al., A universal transgene silencing method based on RNA interference. Nucleic Acids Res. Jul. 12, 2004;32(12):e102. doi: 10.1093/nar/gnh105.
Mangeot et al., Development of minimal lentivirus vectors derived from simian immunodeficiency virus (SIVmac251) and their use for gene transfer into human dendritic cells. J Virol. Sep. 2000;74(18):8307-15. doi: 10.1128/jvi.74.18.8307-8315.2000.
Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.
Mangeot et al., Protein transfer into human cells by VSV-G-induced nanovesicles. Mol Ther. Sep. 2011;19(9):1656-66. doi: 10.1038/mt.2011.138. Epub Jul. 12, 2011.
Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.
Mariani et al., Species-specific exclusion of APOBEC3G from HIV-1 virions by Vif. Cell. Jul. 11, 2003;114(1):21-31. doi: 10.1016/s0092-8674(03)00515-4.
Martín et al., Envelope-targeted retrovirus vectors transduce melanoma xenografts but not spleen or liver. Mol Ther. Mar. 2002;5(3):269-74. doi: 10.1006/mthe.2002.0550.
Mason et al., Coiled coil domains: stability, specificity, and biological implications. Chembiochem. Feb. 6, 2004;5(2):170-6. doi: 10.1002/cbic.200300781.

(56) References Cited

OTHER PUBLICATIONS

Mendell et al., Single-Dose Gene-Replacement Therapy for Spinal Muscular Atrophy. N Engl J Med. Nov. 2, 2017;377(18):1713-1722. doi: 10.1056/NEJMoa1706198.
Meng et al., Identification of an HLA-DPB1*0501 restricted Melan-A/MART-1 epitope recognized by CD4+ T lymphocytes: prevalence for immunotherapy in Asian populations. J Immunother. Sep. 2011;34(7):525-34. doi: 10.1097/CJI.0b013e318226bd45. Author Manuscript. 16 pages.
Mercuri et al., Nusinersen versus Sham Control in Later-Onset Spinal Muscular Atrophy. N Engl J Med. Feb. 15, 2018;378(7):625-635. doi: 10.1056/NEJMoa1710504.
Meunier et al., Drug-Induced Liver Injury: Biomarkers, Requirements, Candidates, and Validation. Front Pharmacol. Dec. 11, 2019;10:1482. doi: 10.3389/fphar.2019.01482.
Miccio et al., Novel genome-editing-based approaches to treat motor neuron diseases: Promises and challenges. Mol Ther. Jan. 5, 2022;30(1):47-53. doi: 10.1016/j.ymthe.2021.04.003. Epub Apr. 3, 2021.
Michaux et al., A spliced antigenic peptide comprising a single spliced amino acid is produced in the proteasome by reverse splicing of a longer peptide fragment followed by trimming. J Immunol. Feb. 15, 2014;192(4):1962-71. doi: 10.4049/jimmunol.1302032. Epub Jan. 22, 2014.
Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.
Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.
Milone et al., Clinical use of lentiviral vectors. Leukemia. Jul. 2018;32(7):1529-1541. doi: 10.1038/s41375-018-0106-0. Epub Mar. 22, 2018.
Min et al., Deep learning in bioinformatics. Brief Bioinform. Sep. 1, 2017;18(5):851-869. doi: 10.1093/bib/bbw068.
Misra et al., An enzymatically active chimeric HIV-1 reverse transcriptase (RT) with the RNase-H domain of murine leukemia virus RT exists as a monomer. J Biol Chem. Apr. 17, 1998;273(16):9785-9. doi: 10.1074/jbc.273.16.9785.
Momose et al., Diving into marine genomics with CRISPR/Cas9 systems. Mar Genomics. Dec. 2016;30:55-65. doi: 10.1016/j.margen.2016.10.003. Epub Oct. 12, 2016.
Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.
Morel et al., A tyrosinase peptide presented by HLA-B35 is recognized on a human melanoma by autologous cytotoxic T lymphocytes. Int J Cancer. Dec. 10, 1999;83(6):755-9. doi: 10.1002/(sici)1097-0215(19991210)83:6<755::aid-ijc10>3.0.co;2-s.
Morrison et al., The developing toolkit of continuous directed evolution. Nat Chem Biol. Jun. 2020;16(6):610-619. doi: 10.1038/s41589-020-0532-y. Epub May 22, 2020.
Mselli-Lakhal et al., Gene transfer system derived from the caprine arthritis-encephalitis lentivirus. J Virol Methods. Sep. 2006;136(1-2):177-84. doi: 10.1016/j.jviromet.2006.05.006. Epub Jun. 21, 2006.
Mullally et al., 5' modifications to CRISPR-Cas9 gRNA can change the dynamics and size of R-loops and inhibit DNA cleavage. Nucleic Acids Res. Jul. 9, 2020;48(12):6811-6823. doi: 10.1093/nar/gkaa477.
Murawski et al., Newcastle disease virus-like particles containing respiratory syncytial virus G protein induced protection in BALB/c mice, with No. evidence of immunopathology. J Virol. Jan. 2010;84(2):1110-23. doi: 10.1128/JVI.01709-09. Epub Nov. 4, 2009.
Murray et al., Selective vulnerability of motor neurons and dissociation of pre- and post- synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.
Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.
Musunuru et al., In vivo CRISPR base editing of PCSK9 durably lowers cholesterol in primates. Nature. May 2021;593(7859):429-434. doi: 10.1038/s41586-021-03534-y. Epub May 19, 2021.
Naskalska et al., Virus Like Particles as Immunogens and Universal Nanocarriers. Pol J Microbiol. 2015;64(1):3-13.
Nawaz et al., Extracellular Vesicles, Tunneling Nanotubes, and Cellular Interplay: Synergies and Missing Links. Front Mol Biosci. Jul. 18, 2017;4:50. doi: 10.3389/fmolb.2017.00050.
Negre et al., Characterization of novel safe lentiviral vectors derived from simian immunodeficiency virus (SIVmac251) that efficiently transduce mature human dendritic cells. Gene Ther. Oct. 2000;7(19):1613-23. doi: 10.1038/sj.gt.3301292.
Nelson et al., Engineered pegRNAs improve prime editing efficiency. Nat Biotechnol. Mar. 2022;40(3):402-410. doi: 10.1038/s41587-021-01039-7. Epub Oct. 4, 2021. Erratum in: Nat Biotechnol. Mar. 2022;40(3):432. doi: 10.1038/s41587-021-01175-0 and Supplemental Information. 15 pages.
Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.
Nesbitt, Targeted Intracellular Therapeutic Delivery Using Liposomes Formulated with Multifunctional FAST proteins. Electronic Thesis and Dissertation Repository. The University of Western Ontario. 2012. 126 pages.
Newby et al., In vivo somatic cell base editing and prime editing. Mol Ther. Nov. 3, 2021;29(11):3107-3124. doi: 10.1016/j.ymthe.2021.09.002. Epub Sep. 10, 2021.
Nguyen Tran et al., Engineering domain-inlaid SaCas9 adenine base editors with reduced RNA off-targets and increased on-target DNA editing. Nat Commun. Sep. 25, 2020;11(1):4871. doi: 10.1038/s41467-020-18715-y.
Niemeyer, C.M., Semisynthetic DNA-protein conjugates for biosensing and nanofabrication. Angew Chem Int Ed Engl. Feb. 8, 2010;49(7):1200-16. doi: 10.1002/anie.200904930.
Noppen et al., Naturally processed and concealed HLA-A2.1-restricted epitopes from tumor-associated antigen tyrosinase-related protein-2. Int J Cancer. Jul. 15, 2000;87(2):241-6.
Nowak et al., Ty3 reverse transcriptase complexed with an RNA-DNA hybrid shows structural and functional asymmetry. Nat Struct Mol Biol. Apr. 2014;21(4):389-96. doi: 10.1038/nsmb.2785. Epub Mar. 9, 2014. Author Manuscript, 22 pages.
Nukaya et al., Identification of HLA-A24 epitope peptides of carcinoembryonic antigen which induce tumor-reactive cytotoxic T lymphocyte. Int J Cancer. Jan. 5, 1999;80(1):92-7. doi: 10.1002/(sici)1097-0215(19990105)80:1<92::aid-ijc18>3.0.co;2-m.
Ogasawara et al., Recombinant viral-like particles of parvovirus B19 as antigen carriers of anthrax protective antigen. In Vivo. May-Jun. 2006;20(3):319-24.
Ohminami et al., HLA class I-restricted lysis of leukemia cells by a CD8(+) cytotoxic T-lymphocyte clone specific for WT1 peptide. Blood. Jan. 1, 2000;95(1):286-93.
Oka et al., WT1 peptide vaccine for the treatment of cancer. Curr Opin Immunol. Apr. 2008;20(2):211-20. doi: 10.1016/j.coi.2008.04.009. Epub May 24, 2008.
Olsen, J.C., Gene transfer vectors derived from equine infectious anemia virus. Gene Ther. Nov. 1998;5(11):1481-7. doi: 10.1038/sj.gt.3300768.
Olson et al., HLA-A2-restricted T-cell epitopes specific for prostatic acid phosphatase. Cancer Immunol Immunother. Jun. 2010;59(6):943-53. doi: 10.1007/s00262-010-0820-6. Epub Feb. 6, 2010.
Osen et al., Screening of human tumor antigens for CD4 T cell epitopes by combination of HLA-transgenic mice, recombinant adenovirus and antigen peptide libraries. PLoS One. Nov. 30, 2010;5(11):e14137. doi: 10.1371/journal.pone.0014137.
Ottesen, ISS-N1 makes the First FDA-approved Drug for Spinal Muscular Atrophy. Transl Neurosci. Jan. 26, 2017;8:1-6. doi: 10.1515/tnsci-2017-0001.

(56) References Cited

OTHER PUBLICATIONS

Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.
Pan et al., Biodistribution and toxicity studies of VSVG-pseudotyped lentiviral vector after intravenous administration in mice with the observation of in vivo transduction of bone marrow. Mol Ther. Jul. 2002;6(1):19-29. doi: 10.1006/mthe.2002.0630.
Pan et al., Identification of a nuclear localization signal in OCT4 and generation of a dominant negative mutant by its ablation. J Biol Chem. Aug. 27, 2004;279(35):37013-20. doi: 10.1074/jbc.M405117200. Epub Jun. 24, 2004.
Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.
Pang et al., Retinal degeneration 12 (rd12): a new, spontaneously arising mouse model for human Leber congenital amaurosis (LCA). Mol Vis. Feb. 28, 2005;11:152-62.
Parente et al., Advances in spinal muscular atrophy therapeutics. Ther Adv Neurol Disord. Feb. 5, 2018;11:1756285618754501. doi: 10.1177/1756285618754501. 13 pages.
Park et al., Targeted mutagenesis in mouse cells and embryos using an enhanced prime editor. Genome Biol. Jun. 3, 2021;22(1):170. doi: 10.1186/s13059-021-02389-w.
Parkhurst et al., Identification of a shared HLA-A*0201-restricted T-cell epitope from the melanoma antigen tyrosinase-related protein 2 (TRP2). Cancer Res. Nov. 1, 1998;58(21):4895-901.
Parkhurst et al., Induction of CD4+ Th1 lymphocytes that recognize known and novel class II MHC restricted epitopes from the melanoma antigen gp100 by stimulation with recombinant protein. J Immunother. Mar.-Apr. 2004;27(2):79-91. doi: 10.1097/00002371-200403000-00001. Author Manuscript. 22 pages.
Parr-Brownlie et al., Lentiviral vectors as tools to understand central nervous system biology in mammalian model organisms. Front Mol Neurosci. May 18, 2015;8:14. doi: 10.3389/fnmol.2015.00014.
Parsons et al., Hypermutability and mismatch repair deficiency in RER+ tumor cells. Cell. Dec. 17, 1993;75(6):1227-36. doi: 10.1016/0092-8674(93)90331-j.
Paschen et al., Detection of spontaneous CD4+ T-cell responses in melanoma patients against a tyrosinase-related protein-2-derived epitope identified in HLA-DRB1*0301 transgenic mice. Clin Cancer Res. Jul. 15, 2005;11(14):5241-7. doi: 10.1158/1078-0432.CCR-05-0170.
Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.
Pastuzyn et al., The Neuronal Gene Arc Encodes a Repurposed Retrotransposon Gag Protein that Mediates Intercellular RNA Transfer. Cell. Jan. 11, 2018;172(1-2):275-288.e18. doi: 10.1016/j.cell.2017.12.024. Erratum in: Cell. Mar. 22, 2018;173(1):275. doi: 10.1016/j.cell.2018.03.024.
Pavlov et al., Roles of DNA polymerases in replication, repair, and recombination in eukaryotes. Int Rev Cytol. 2006;255:41-132. doi: 10.1016/S0074-7696(06)55002-8.
Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.
Pendse et al., In Vivo Assessment of Potential Therapeutic Approaches for USH2A-Associated Diseases. Adv Exp Med Biol. 2019;1185:91-96. doi: 10.1007/978-3-030-27378-1_15.
Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.
Petit et al., Powerful mutators lurking in the genome. Philos Trans R Soc Lond B Biol Sci. Mar. 12, 2009;364(1517):705-15. doi: 10.1098/rstb.2008.0272.
Petri et al., CRISPR prime editing with ribonucleoprotein complexes in zebrafish and primary human cells. Nat Biotechnol. Feb. 2022;40(2):189-193. doi: 10.1038/s41587-021-00901-y. Epub Apr. 29, 2021. Erratum in: Nat Biotechnol. May 13, 2021.
Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.
Pinilla et al., Combinatorial peptide libraries as an alternative approach to the identification of ligands for tumor-reactive cytolytic T lymphocytes. Cancer Res. Jul. 1, 2001;61(13):5153-60.
Pinilla-Ibarz et al., Improved human T-cell responses against synthetic HLA-0201 analog peptides derived from the WT1 oncoprotein. Leukemia. Nov. 2006;20(11):2025-33. doi: 10.1038/sj.leu.2404380. Epub Aug. 31, 2006.
Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.
Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.
Podbilewicz, Virus and cell fusion mechanisms. Annu Rev Cell Dev Biol. 2014;30:111-39. doi: 10.1146/annurev-cellbio-101512-122422. Epub Jun. 27, 2014.
Podracky et al., Laboratory evolution of a sortase enzyme that modifies amyloid-β protein. Nat Chem Biol. Mar. 2021;17(3):317-325. doi: 10.1038/s41589-020-00706-1. Epub Jan. 11, 2021.
Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.
Porter et al., Therapeutic promise of engineered nonsense suppressor tRNAs. Wiley Interdiscip Rev RNA. Jul. 2021;12(4):e1641. doi: 10.1002/wrna.1641. Epub Feb. 10, 2021.
Prather et al., De novo biosynthetic pathways: rational design of microbial chemical factories. Curr Opin Biotechnol. Oct. 2008;19(5):468-74. doi: 10.1016/j.copbio.2008.07.009. Epub Sep. 5, 2008.
Puppo et al., Retinal transduction profiles by high-capacity viral vectors. Gene Ther. Oct. 2014;21(10):855-65. doi: 10.1038/gt.2014.57. Epub Jul. 3, 2014.
Qi et al., Repurposing CRISPR as an RNA-guided platform for sequence-specific control of gene expression. Cell. Feb. 28, 2013;152(5):Supplementary Material. doi: 10.1016/j.cell.2013.02.022. 4 pages.
Quan et al., Influenza M1 VLPs containing neuraminidase induce heterosubtypic cross-protection. Virology. Sep. 1, 2012;430(2):127-35. doi: 10.1016/j.virol.2012.05.006. Epub Jun. 2, 2012.
Raaijmakers et al., CRISPR/Cas Applications in Myotonic Dystrophy: Expanding Opportunities. Int J Mol Sci. Jul. 27, 2019;20(15):3689. doi: 10.3390/ijms20153689.
Rajagopal et al., High-throughput mapping of regulatory DNA. Nat Biotechnol. Feb. 2016;34(2):167-74. doi: 10.1038/nbt.3468. Epub Jan. 25, 2016.
Ramiro et al., Transcription enhances AID-mediated cytidine deamination by exposing single-stranded DNA on the nontemplate strand. Nat Immunol. May 2003;4(5):452-6. doi: 10.1038/ni920.
Ramos et al., Age-dependent SMN expression in disease-relevant tissue and implications for SMA treatment. J Clin Invest. Nov. 1, 2019;129(11):4817-4831. doi: 10.1172/JCI124120.
Rao et al., Large-Scale Phenome-Wide Association Study of PCSK9 Variants Demonstrates Protection Against Ischemic Stroke. Circ Genom Precis Med. Jul. 2018;11(7):e002162. doi: 10.1161/CIRCGEN.118.002162.
Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.

(56) References Cited

OTHER PUBLICATIONS

Rasmussen et al., Characterization of virus-like particles produced by a recombinant baculovirus containing the gag gene of the bovine immunodeficiency-like virus. Virology. Oct. 1990; 178(2):435-51. doi: 10.1016/0042-6822(90)90341-n.
Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.
Remington et al., Complete nucleotide sequence of a neuropathogenic variant of Friend murine leukemia virus PVC-211. Nucleic Acids Res. Jun. 25, 1992;20(12):3249. doi: 10.1093/nar/20.12.3249.
Renner et al., Intact Viral Particle Counts Measured by Flow Virometry Provide Insight into the Infectivity and Genome Packaging Efficiency of Moloney Murine Leukemia Virus. J Virol. Jan. 6, 2020;94(2):e01600-19. doi: 10.1128/JVI.01600-19.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020. Author Manuscript, 30 pages.
Riddle et al., Frameshift suppression: a nucleotide addition in the anticodon of a glycine transfer RNA. Nat New Biol. Apr. 25, 1973;242(121):230-4. doi: 10.1038/newbio242230a0.
Riddle et al., Frameshift suppressors. II. Genetic mapping and dominance studies. J Mol Biol. May 28, 1972;66(3):483-93. doi: 10.1016/0022-2836(72)90428-7.
Riddle et al., Suppressors of frameshift mutations in Salmonella typhimurium. J Mol Biol. Nov. 28, 1970;54(1): 131-44. doi: 10.1016/0022-2836(70)90451-1.
Riley et al., Identification of a new shared HLA-A2.1 restricted epitope from the melanoma antigen tyrosinase. J Immunother. May-Jun. 2001;24(3):212-20.
Rimoldi et al., Efficient simultaneous presentation of NY-ESO-1/LAGE-1 primary and nonprimary open reading frame-derived CTL epitopes in melanoma. J Immunol. Dec. 15, 2000;165(12):7253-61. doi: 10.4049/jimmunol.165.12.7253.
Robbins et al., Multiple HLA class II-restricted melanocyte differentiation antigens are recognized by tumor-infiltrating lymphocytes from a patient with melanoma. J Immunol. Nov. 15, 2002;169(10):6036-47. doi: 10.4049/jimmunol.169.10.6036.
Robbins et al., The intronic region of an incompletely spliced gp100 gene transcript encodes an epitope recognized by melanoma-reactive tumor-infiltrating lymphocytes. J Immunol. Jul. 1, 1997;159(1):303-8.
Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.
Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.
Rohovie et al., Virus-like particles: Next-generation nanoparticles for targeted therapeutic delivery. Bioeng Transl Med. Jan. 19, 2017;2(1):43-57. doi: 10.1002/btm2.10049.
Romero et al., Exploring protein fitness landscapes by directed evolution. Nat Rev Mol Cell Biol. Dec. 2009;10(12):866-76. doi: 10.1038/nrm2805.
Rosenberg et al., Immunologic and therapeutic evaluation of a synthetic peptide vaccine for the treatment of patients with metastatic melanoma. Nat Med. Mar. 1998;4(3):321-7. doi: 10.1038/nm0398-321.
Rothgangl et al., In vivo adenine base editing of PCSK9 in macaques reduces LDL cholesterol levels. Nat Biotechnol. Aug. 2021;39(8):949-957. doi: 10.1038/s41587-021-00933-4. Epub May 19, 2021.
Rubio-Godoy et al., Toward synthetic combinatorial peptide libraries in positional scanning format (PS-SCL)-based identification of CD8+ Tumor-reactive T-Cell Ligands: a comparative analysis of PS-SCL recognition by a single tumor-reactive CD8+ cytolytic T-lymphocyte clone. Cancer Res. Apr. 1, 2002;62(7):2058-63.
Ruiz et al., Identification and characterization of a T-helper peptide from carcinoembryonic antigen. Clin Cancer Res. Apr. 15, 2004;10(8):2860-7. doi: 10.1158/1078-0432.ccr-03-0476.
Rusk, Cas9 and the importance of asymmetry. Nat Methods. Apr. 2016;13(4):286-7. doi: 10.1038/nmeth.3826.
Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.
Sadowski et al., The sequence-structure relationship and protein function prediction. Curr Opin Struct Biol. Jun. 2009;19(3):357-62. doi: 10.1016/j.sbi.2009.03.008. Epub May 4, 2009.
Saenger et al., Improved tumor immunity using anti-tyrosinase related protein-1 monoclonal antibody combined with DNA vaccines in murine melanoma. Cancer Res. Dec. 1, 2008;68(23):9884-91. doi: 10.1158/0008-5472.CAN-08-2233. Author Manuscript. 19 pages.
Saenz et al., Feline immunodeficiency virus-based lentiviral vectors. Cold Spring Harb Protoc. Jan. 1, 2012;2012(1):71-6. doi: 10.1101/pdb.ip067579.
Saenz et al., Production, harvest, and concentration of feline immunodeficiency virus-based lentiviral vector from cells grown in CF10 or CF2 devices. Cold Spring Harb Protoc. Jan. 1, 2012;2012(1):118-23. doi: 10.1101/pdb.prot067546.
Sakuma et al., Multiplex genome engineering in human cells using all-in-one CRISPR/Cas9 vector system. Sci Rep. Jun. 23, 2014;4:5400. doi: 10.1038/srep05400.
Sanjana et al., Improved vectors and genome-wide libraries for CRISPR screening. Nat Methods. Aug. 2014;11(8):783-784. doi: 10.1038/nmeth.3047.
Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.
Sapir et al., Viral and developmental cell fusion mechanisms: conservation and divergence. Dev Cell. Jan. 2008;14(1):11-21. doi: 10.1016/j.devcel.2007.12.008.
Schellekens, Bioequivalence and the immunogenicity of biopharmaceuticals. Nat Rev Drug Discov. Jun. 2002;1(6):457-62. doi: 10.1038/nrd818.
Schene et al., Prime editing for functional repair in patient-derived disease models. Nat Commun. Oct. 23, 2020;11(1):5352. doi: 10.1038/s41467-020-19136-7.
Schneider et al., MuLV IN mutants responsive to HDAC inhibitors enhance transcription from unintegrated retroviral DNA. Virology. May 10, 2012;426(2):188-96. doi: 10.1016/j.virol.2012.01.034. Epub Feb. 23, 2012.
Schneider et al., Overlapping peptides of melanocyte differentiation antigen Melan-A/MART-1 recognized by autologous cytolytic T lymphocytes in association with HLA-B45.1 and HLA-A2.1. Int J Cancer. Jan. 30, 1998;75(3):451-8. doi: 10.1002/(sici)1097-0215(19980130)75:3<451::aid-ijc20>3.0.co;2-a.
Scholefield et al., Prime editing—an update on the field. Gene Ther. Aug. 2021;28(7-8):396-401. doi: 10.1038/s41434-021-00263-9. Epub May 24, 2021.
Schrank et al., Inactivation of the survival motor neuron gene, a candidate gene for human spinal muscular atrophy, leads to massive cell death in early mouse embryos. Proc Natl Acad Sci USA. Sep. 2, 1997;94(18):9920-5. doi: 10.1073/pnas.94.18.9920.
SCORE Results for US 2014-0186919 A1 to Zhang et al. Aug. 28, 2014. 3 pages.
Seffernick et al., Melamine deaminase and atrazine chlorohydrolase: 98 percent identical but functionally different. J Bacteriol. Apr. 2001;183(8):2405-10. doi: 10.1128/JB.183.8.2405- 2410.2001.
Segel et al., Mammalian retrovirus-like protein PEG10 packages its own mRNA and can be pseudotyped for mRNA delivery. Science. Aug. 20, 2021;373(6557):882-889. doi: 10.1126/science.abg6155.
Semple et al., Brain development in rodents and humans: Identifying benchmarks of maturation and vulnerability to injury across species. Prog Neurobiol. Jul.-Aug. 2013;106-107:1-16. doi: 10.1016/j.pneurobio.2013.04.001. Epub Apr. 11, 2013.
Sensi et al., Identification of a novel gp100/pMel17 peptide presented by HLA-A*6801 and recognized on human melanoma by

(56) References Cited

OTHER PUBLICATIONS cytolytic T cell clones. Tissue Antigens. Apr. 2002;59(4):273-9. doi: 10.1034/j.1399-0039.2002.590404.x.
Serreze et al., Major histocompatibility complex class I-deficient NOD-B2mnull mice are diabetes and insulitis resistant. Diabetes. Mar. 1994;43(3):505-9. doi: 10.2337/diab.43.3.505.
Shalaby et al., Tissue-Specific Delivery of CRISPR Therapeutics: Strategies and Mechanisms of Non-Viral Vectors. Int J Mol Sci. Oct. 5, 2020;21(19):7353. doi: 10.3390/ijms21197353.
Shams et al., Comprehensive deletion landscape of CRISPR-Cas9 identifies minimal RNA-guided DNA-binding modules. Nat Commun. Sep. 27, 2021;12(1):5664. doi: 10.1038/s41467-021-25992-8.
Shang et al., The spontaneous CD8+ T-cell response to HLA-A2-restricted NY-ESO-1b peptide in hepatocellular carcinoma patients. Clin Cancer Res. Oct. 15, 2004;10(20):6946-55. doi: 10.1158/1078-0432.CCR-04-0502.
Sharma et al., Noninfectious virus-like particles produced by Moloney murine leukemia virus-based retrovirus packaging cells deficient in viral envelope become infectious in the presence of lipofection reagents. Proc Natl Acad Sci U S A. Sep. 30, 1997;94(20):10803-8. doi: 10.1073/pnas.94.20.10803.
Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.
Shellenberger et al., A recombinant polypeptide extends the in vivo half-life of peptides and proteins in a tunable manner. Nat Biotechnol. Dec. 2009;27(12):1186-90. doi: 10.1038/nbt.1588.
Shen et al., Activation-induced cytidine deaminase (AID) can target both DNA strands when the DNA is supercoiled. Proc Natl Acad Sci U S A. Aug. 31, 2004;101(35):12997-3002. doi: 10.1073/pnas.0404974101. Epub Aug. 24, 2004.
Shen et al., Identification of a MHC class-II restricted epitope in carcinoembryonic antigen. Cancer Immunol Immunother. May 2004;53(5):391-403. doi: 10.1007/s00262-003-0455-y. Epub Nov. 18, 2003.
Shim et al., Nonviral Delivery Systems for Cancer Gene Therapy: Strategies and Challenges. Curr Gene Ther. 2018;18(1):3-20. doi: 10.2174/1566523218666180119121949.
Simon et al., Retrons and their applications in genome engineering. Nucleic Acids Res. Dec. 2, 2019;47(21):11007-11019. doi: 10.1093/nar/gkz865.
Singh et al., Protein Engineering Approaches in the Post-Genomic Era. Curr Protein Pept Sci. 2018;19(1):5-15. doi: 10.2174/1389203718666161117114243.
Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.
Skipper et al., An HLA-A2-restricted tyrosinase antigen on melanoma cells results from posttranslational modification and suggests a novel pathway for processing of membrane proteins. J Exp Med. Feb. 1, 1996;183(2):527-34. doi: 10.1084/jem.183.2.527.
Skipper et al., Delivering the Goods for Genome Engineering and Editing. Hum Gene Ther. Aug. 2015;26(8):486-97. doi: 10.1089/hum.2015.063.
Skipper et al., Shared epitopes for HLA-A3-restricted melanoma-reactive human CTL include a naturally processed epitope from Pmel-17/gp100. J Immunol. Dec. 1, 1996;157(11):5027-33.
Slansky et al., Enhanced antigen-specific antitumor immunity with altered peptide ligands that stabilize the MHC-peptide-TCR complex. Immunity. Oct. 2000;13(4):529-38. doi: 10.1016/s1074-7613(00)00052-2.
Slingluff et al., Clinical and immunologic results of a randomized phase II trial of vaccination using four melanoma peptides either administered in granulocyte-macrophage colony-stimulating factor in adjuvant or pulsed on dendritic cells. J Clin Oncol. Nov. 1, 2003;21(21):4016-26. doi: 10.1200/JCO.2003.10.005.
Slingluff et al., Immunologic and clinical outcomes of vaccination with a multiepitope melanoma peptide vaccine plus low-dose interleukin-2 administered either concurrently or on a delayed schedule. J Clin Oncol. Nov. 15, 2004;22(22):4474-85. doi: 10.1200/JCO.2004.10.212.
Sodi et al., RPE65-associated inherited retinal diseases: consensus recommendations for eligibility to gene therapy. Orphanet J Rare Dis. Jun. 4, 2021;16(1):257. doi: 10.1186/s13023-021-01868-4.
Song et al., Large-Fragment Deletions Induced by Cas9 Cleavage while Not in the BEs System. Mol Ther Nucleic Acids. Sep. 4, 2020;21:523-526. doi: 10.1016/j.omtn.2020.06.019. Epub Jun. 25, 2020.
Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.
Stadtmauer et al., CRISPR-engineered T cells in patients with refractory cancer. Science. Feb. 28, 2020;367(6481):eaba7365. doi: 10.1126/science.aba7365. Epub Feb. 6, 2020.
Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.
Stevens et al., Design of a Split Intein with Exceptional Protein Splicing Activity. J Am Chem Soc. Feb. 24, 2016;138(7):2162-5. doi: 10.1021/jacs.5b13528. Epub Feb. 8, 2016. Abstract Only. 1 page.
Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.
Studebaker et al., Depletion of uracil-DNA glycosylase activity is associated with decreased cell proliferation. Biochem Biophys Res Commun. Aug. 26, 2005;334(2):509-15. doi: 10.1016/j.bbrc.2005.06.118.
Su et al., Mispair specificity of methyl-directed DNA mismatch correction in vitro. J Biol Chem. May 15, 1988;263(14):6829-35. Erratum in: J Biol Chem Aug. 5, 1988;263(22):11015.
Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.
Suh et al., Publisher Correction: Restoration of visual function in adult mice with an inherited retinal disease via adenine base editing. Nat Biomed Eng. Nov. 2020;4(11):1119. doi: 10.1038/s41551-020-00652-2. Erratum for: Nat Biomed Eng. Oct. 19, 2020.
Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.
Supek et al., Differential DNA mismatch repair underlies mutation rate variation across the human genome. Nature. May 7, 2015;521(7550):81-4. doi: 10.1038/nature14173. Epub Feb. 23, 2015.
Svitashev et al., Targeted Mutagenesis, Precise Gene Editing, and Site-Specific Gene Insertion in Maize Using Cas9 and Guide RNA. Plant Physiol. Oct. 2015;169(2):931-45. doi: 10.1104/pp.15.00793. Epub Aug. 12, 2015.
Swiech et al., In vivo interrogation of gene function in the mammalian brain using CRISPR-Cas9. Nat Biotechnol. Jan. 2015;33(1):102-6. doi: 10.1038/nbt.3055. Epub Oct. 19, 2014. Author Manuscript. 22 pages.
Taha et al., Delivery of CRISPR-Cas tools for in vivo genome editing therapy: Trends and challenges. J Control Release. Feb. 2022;342:345-361. doi: 10.1016/j.jconrel.2022.01.013. Epub Jan. 10, 2022.
Talbot et al., Spinal muscular atrophy. Semin Neurol. Jun. 2001;21(2):189-97. doi: 10.1055/s-2001-15264.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Tang et al., Identification of Dehalobacter reductive dehalogenases that catalyse dechlorination of chloroform, 1,1,1-trichloroethane and 1,1-dichloroethane. Philos Trans R Soc Lond B Biol Sci. Mar. 11, 2013;368(1616):20120318. doi: 10.1098/rstb.2012.0318.

(56) References Cited

OTHER PUBLICATIONS

Tang et al., The *Arabidopsis* TRM61/TRM6 complex is a bona fide tRNA N1-methyladenosine methyltransferase. J Exp Bot. May 30, 2020;71(10):3024-3036. doi: 10.1093/jxb/eraa100.
Tangri et al., Structural features of peptide analogs of human histocompatibility leukocyte antigen class I epitopes that are more potent and immunogenic than wild-type peptide. J Exp Med. Sep. 17, 2001;194(6):833-46. doi: 10.1084/jem.194.6.833.
Taylor, Ocular immune privilege. Eye (Lond). Oct. 2009;23(10):1885-9. doi: 10.1038/eye.2008.382. Epub Jan. 9, 2009.
Thakore et al., Highly specific epigenome editing by CRISPR-Cas9 repressors for silencing of distal regulatory elements. Nat Methods. Dec. 2015;12(12):1143-9. doi: 10.1038/nmeth.3630. Epub Oct. 26, 2015.
Thandapani et al., Valine tRNA levels and availability regulate complex I assembly in leukaemia. Nature. Jan. 2022;601(7893):428-433. doi: 10.1038/s41586-021-04244-1. Epub Dec. 22, 2021.
Thomas et al., Heteroduplex repair in extracts of human HeLa cells. J Biol Chem. Feb. 25, 1991;266(6):3744-51.
Thorne et al., In vivo diffusion analysis with quantum dots and dextrans predicts the width of brain extracellular space. Proc Natl Acad Sci U S A. Apr. 4, 2006;103(14):5567-72. doi: 10.1073/pnas.0509425103. Epub Mar. 27, 2006.
Tomé-Amat et al., Secreted production of assembled Norovirus virus-like particles from Pichia pastoris. Microb Cell Fact. Sep. 10, 2014;13:134. doi: 10.1186/s12934-014-0134-z.
Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.
Topalian et al., Melanoma-specific CD4+ T cells recognize nonmutated HLA-DR-restricted tyrosinase epitopes. J Exp Med. May 1, 1996;183(5):1965-71. doi: 10.1084/jem.183.5.1965.
Toro et al., Comprehensive phylogenetic analysis of bacterial reverse transcriptases. PLoS One. Nov. 25, 2014;9(11):e114083. doi: 10.1371/journal.pone.0114083.
Touloukian et al., Expression of a "self-"antigen by human tumor cells enhances tumor antigen-specific CD4(+) T-cell function. Cancer Res. Sep. 15, 2002;62(18):5144-7. Author Manuscript. 11 pages.
Touloukian et al., Identification of a MHC class II-restricted human gp100 epitope using DR4-IE transgenic mice. J Immunol. Apr. 1, 2000;164(7):3535-42. doi: 10.4049/jimmunol.164.7.3535.
Touloukian et al., Normal tissue depresses while tumor tissue enhances human T cell responses in vivo to a novel self/tumor melanoma antigen, OA1. J Immunol. Feb. 1, 2003;170(3):1579-85. doi: 10.4049/jimmunol.170.3.1579.
Tözsér, Comparative studies on retroviral proteases: substrate specificity. Viruses. Jan. 2010;2(1):147-165. doi: 10.3390/v2010147. Epub Jan. 14, 2010.
Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.
Trojan et al., Generation of cytotoxic T lymphocytes against native and altered peptides of human leukocyte antigen-A*0201 restricted epitopes from the human epithelial cell adhesion molecule. Cancer Res. Jun. 15, 2001;61(12):4761-5.
Tsai et al., Identification of subdominant CTL epitopes of the GP100 melanoma-associated tumor antigen by primary in vitro immunization with peptide-pulsed dendritic cells. J Immunol. Feb. 15, 1997;158(4):1796-802.
Tsang et al., A human cytotoxic T-lymphocyte epitope and its agonist epitope from the nonvariable No. of tandem repeat sequence of MUC-1. Clin Cancer Res. Mar. 15, 2004;10(6):2139-49. doi: 10.1158/1078-0432.ccr-1011-03.
Tsang et al., Generation of human cytotoxic T cells specific for human carcinoembryonic antigen epitopes from patients immunized with recombinant vaccinia-CEA vaccine. J Natl Cancer Inst. Jul. 5, 1995;87(13):982-90. doi: 10.1093/jnci/87.13.982.
Tsuboi et al., Enhanced induction of human WT1-specific cytotoxic T lymphocytes with a 9-mer WT1 peptide modified at HLA-A*2402-binding residues. Cancer Immunol Immunother. Dec. 2002;51(11-12):614-20. doi: 10.1007/s00262-002-0328-9. Epub Oct. 18, 2002.
Tuorto et al., Genome recoding by tRNA modifications. Open Biol. Dec. 2016;6(12):160287. doi: 10.1098/rsob.160287.
Turchiano et al., Quantitative evaluation of chromosomal rearrangements in gene-edited human stem cells by CAST-Seq. Cell Stem Cell. Jun. 3, 2021;28(6):1136-1147.e5. doi: 10.1016/j.stem.2021.02.002. Epub Feb. 23, 2021.
Tycko et al., Methods for Optimizing CRISPR-Cas9 Genome Editing Specificity. Mol Cell. Aug. 4, 2016;63(3):355-70. doi: 10.1016/j.molcel.2016.07.004.
Umar et al., DNA loop repair by human cell extracts. Science. Nov. 4, 1994;266(5186):814-6. doi: 10.1126/science.7973637.
Urano et al., Substitution of the myristoylation signal of human immunodeficiency virus type 1 Pr55Gag with the phospholipase C-deltal pleckstrin homology domain results in infectious pseudovirion production. J Gen Virol. Dec. 2008;89(Pt 12):3144-3149. doi: 10.1099/vir.0.2008/004820-0.
Valmori et al., Analysis of the cytolytic T lymphocyte response of melanoma patients to the naturally HLA-A*0201-associated tyrosinase peptide 368-376. Cancer Res. Aug. 15, 1999;59(16):4050-5.
Valmori et al., Enhanced generation of specific tumor-reactive CTL in vitro by selected Melan-A/MART-1 immunodominant peptide analogues. J Immunol. Feb. 15, 1998;160(4):1750-8.
Valmori et al., Naturally occurring human lymphocyte antigen-A2 restricted CD8+ T-cell response to the cancer testis antigen NY-ESO-1 in melanoma patients. Cancer Res. Aug. 15, 2000;60(16):4499-506.
Van Den Oord et al., Pixel Recurrent Neural Networks. Proceedings of the 33rd International Conference on Machine Learning. Journal of Machine Learning Research. Aug. 19, 2016. vol. 48. 11 pages.
Van Essen et al., CRISPR-Cas Gene Perturbation and Editing in Human Induced Pluripotent Stem Cells. Crispr J. Oct. 2021;4(5):634-655. doi: 10.1089/crispr.2021.0063. Epub Sep. 28, 2021.
Vidal et al., Yeast forward and reverse 'n'-hybrid systems. Nucleic Acids Res. Feb. 15, 1999;27(4):919-29. doi: 10.1093/nar/27.4.919.
Vigneron et al., A peptide derived from melanocytic protein gp100 and presented by HLA-B35 is recognized by autologous cytolytic T lymphocytes on melanoma cells. Tissue Antigens. Feb. 2005;65(2):156-62. doi: 10.1111/j.1399-0039.2005.00365.x.
Vigneron et al., An antigenic peptide produced by peptide splicing in the proteasome. Science. Apr. 23, 2004;304(5670):587-90. doi: 10.1126/science.1095522.
Visseren et al., Affinity, specificity and T-cell-receptor diversity of melanoma-specific CTL generated in vitro against a single tyrosinase epitope. Int J Cancer. Sep. 17, 1997;72(6):1122-8. doi: 10.1002/(sici)1097-0215(19970917)72:6<1122::aid-ijc30>3.0.co;2-3.
Voelkel et al., Protein transduction from retroviral Gag precursors. Proc Natl Acad Sci U S A. Apr. 27, 2010;107(17):7805-10. doi: 10.1073/pnas.0914517107. Epub Apr. 12, 2010.
Voisset et al., Phylogeny of a novel family of human endogenous retrovirus sequences, HERV-W, in humans and other primates. AIDS Res Hum Retroviruses. Nov. 20, 1999;15(17):1529-33. doi: 10.1089/088922299309810.
Volpe et al., Alternative BCR/ABL splice variants in Philadelphia chromosome-positive leukemias result in novel tumor-specific fusion proteins that may represent potential targets for immunotherapy approaches. Cancer Res. Jun. 1, 2007;67(11):5300-7. doi: 10.1158/0008-5472.CAN-06-3737.
Voutev et al., Bxb1 phage recombinase assists genome engineering in *Drosophila melanogaster*. Biotechniques. Jan. 1, 2017;62(1):37-38. doi: 10.2144/000114494.
Walpita et al., Mammalian Cell-Derived Respiratory Syncytial Virus-Like Particles Protect the Lower as well as the Upper Respiratory Tract. PLoS One. Jul. 14, 2015;10(7):e0130755. doi: 10.1371/journal.pone.0130755.
Walton et al., Spontaneous CD8 T cell responses against the melanocyte differentiation antigen RAB38/NY-MEL-1 in melanoma patients. J Immunol. Dec. 1, 2006;177(11):8212-8. doi: 10.4049/jimmunol.177.11.8212.

(56) References Cited

OTHER PUBLICATIONS

Walton et al., Unconstrained genome targeting with near-PAMless engineered CRISPR-Cas9 variants. Science. Apr. 17, 2020;368(6488):290-296. doi: 10.1126/science.aba8853. Epub Mar. 26, 2020.
Wang et al., Characterization of an MPS I-H knock-in mouse that carries a nonsense mutation analogous to the human IDUA-W402X mutation. Mol Genet Metab. Jan. 2010;99(1):62-71. doi: 10.1016/j.ymgme.2009.08.002. Erratum in: Mol Genet Metab. Apr. 2010;99(4):439.
Wang et al., CRISPR/Cas9 in Genome Editing and Beyond. Annu Rev Biochem. Jun. 2, 2016;85:227-64. doi: 10.1146/annurev-biochem-060815-014607. Epub Apr. 25, 2016.
Wang et al., CRISPR-Based Therapeutic Genome Editing: Strategies and In Vivo Delivery by AAV Vectors. Cell. Apr. 2, 2020;181(1):136-150. doi: 10.1016/j.cell.2020.03.023.
Wang et al., Influence of the polyanion on the physico-chemical properties and biological activities of polyanion/DNA/polycation ternary polyplexes. Acta Biomater. Aug. 2012;8(8):3014-26. doi: 10.1016/j.actbio.2012.04.034. Epub Apr. 27, 2012.
Wang et al., Recognition of an antigenic peptide derived from tyrosinase-related protein-2 by CTL in the context of HLA-A31 and -A33. J Immunol. Jan. 15, 1998;160(2):890-7.
Wang et al., Recognition of breast cancer cells by CD8+ cytotoxic T-cell clones specific for NY-BR-1. Cancer Res. Jul. 1, 2006;66(13):6826-33. doi: 10.1158/0008-5472.CAN-05-3529.
Wang et al., Utilization of an alternative open reading frame of a normal gene in generating a novel human cancer antigen. J Exp Med. Mar. 1, 1996;183(3):1131-40. doi: 10.1084/jem.183.3.1131.
Wang et al., Virus-like particles for the prevention of human papillomavirus-associated malignancies. Expert Rev Vaccines. Feb. 2013;12(2):129-41. doi: 10.1586/erv.12.151. Author Manuscript, 22 pages.
Warren et al., Structure of the human MutSalpha DNA lesion recognition complex. Mol Cell. May 25, 2007;26(4):579-92. doi: 10.1016/j.molcel.2007.04.018.
Webber et al., Highly efficient multiplex human T cell engineering without double-strand breaks using Cas9 base editors. Nat Commun. Nov. 19, 2019;10(1):5222. doi: 10.1038/s41467-019-13007-6. Erratum in: Nat Commun. Dec. 6, 2019;10(1):5659. doi: 10.1038/s41467-019-13778-y.
Wei et al., Systemic nanoparticle delivery of CRISPR-Cas9 ribonucleoproteins for effective tissue specific genome editing. Nat Commun. Jun. 26, 2020;11(1):3232. doi: 10.1038/s41467-020-17029-3.
Wheeler et al., Proteomics analysis of cellular components in lentiviral vector production using Gel-LC-MS/MS. Proteomics Clin Appl. Feb. 2007;1(2):224-30. doi: 10.1002/prca.200600522. Epub Jan. 22, 2007.
Wirth et al., Mildly affected patients with spinal muscular atrophy are partially protected by an increased SMN2 copy number. Hum Genet. May 2006;119(4):422-8. doi: 10.1007/s00439-006-0156-7. Epub Mar. 1, 2006.
Witkowski et al., Conversion of a beta-ketoacyl synthase to a malonyl decarboxylase by replacement of the active-site cysteine with glutamine. Biochemistry. Sep. 7, 1999;38(36):11643-50. doi: 10.1021/bi990993h.
Wölfel et al., Two tyrosinase nonapeptides recognized on HLA-A2 melanomas by autologous cytolytic T lymphocytes. Eur J Immunol. Mar. 1994;24(3):759-64. doi: 10.1002/eji.1830240340.
Woo et al., Gene activation of SMN by selective disruption of IncRNA-mediated recruitment of PRC2 for the treatment of spinal muscular atrophy. Proc Natl Acad Sci U S A. Feb. 21, 2017;114(8):E1509-E1518. doi: 10.1073/pnas.1616521114. Epub Feb. 13, 2017.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Wu et al., Effect of genome size on AAV vector packaging. Mol Ther. Jan. 2010;18(1):80-6. doi: 10.1038/mt.2009.255. Epub Nov. 10, 2009.
Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.
Wu et al., Widespread Influence of 3'-End Structures on Mammalian mRNA Processing and Stability. Cell. May 18, 2017;169(5):905-917.e11. doi: 10.1016/j.cell.2017.04.036.
Xi et al., C-terminal Loop Mutations Determine Folding and Secretion Properties of PCSK9. Biochem Mol Biol J. 2016;2(3):17. doi: 10.21767/2471-8084.100026. 12 pages.
Xu et al., Cas9-based tools for targeted genome editing and transcriptional control. Appl Environ Microbiol. Mar. 2014;80(5):1544-52. doi: 10.1128/AEM.03786-13. Epub Jan. 3, 2014.
Xu et al., Engineered miniature CRISPR-Cas system for mammalian genome regulation and editing. Mol Cell. Oct. 21, 2021;81(20):4333-4345.e4. doi: 10.1016/j.molcel.2021.08.008. Epub Sep. 3, 2021.
Xu et al., Sequence and structural analyses of nuclear export signals in the NESdb database. Mol Biol Cell. Sep. 2012;23(18):3677-93. doi: 10.1091/mbc.E12-01-0046. Epub Jul. 25, 2012.
Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.
Yang et al., HIV-1 virus-like particles produced by stably transfected Drosophila S2 cells: a desirable vaccine component. J Virol. Jul. 2012;86(14):7662-76. doi: 10.1128/JVI.07164-11. Epub May 2, 2012.
Yao et al., Engineered extracellular vesicles as versatile ribonucleoprotein delivery vehicles for efficient and safe CRISPR genome editing. J Extracell Vesicles. Mar. 2021;10(5):e12076. doi: 10.1002/jev2.12076. Epub Mar. 16, 2021.
Yee et al., A general method for the generation of high-titer, pantropic retroviral vectors: highly efficient infection of primary hepatocytes. Proc Natl Acad Sci U S A. Sep. 27, 1994;91(20):9564-8. doi: 10.1073/pnas.91.20.9564.
Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.
Yin et al., Optimizing genome editing strategy by primer-extension-mediated sequencing. Cell Discov. Mar. 26, 2019;5:18. doi: 10.1038/s41421-019-0088-8.
Yu et al., Cytosine base editors with minimized unguided DNA and RNA off-target events and high on-target activity. Nat Commun. Apr. 28, 2020;11(1):2052. doi: 10.1038/s41467-020-15887-5.
Yu et al., Poor immunogenicity of a self/tumor antigen derives from peptide-MHC-I instability and is independent of tolerance. J Clin Invest. Aug. 2004; 114(4):551-9. doi: 10.1172/JCI21695.
Zarour et al., Melan-A/MART-1(51-73) represents an immunogenic HLA-DR4-restricted epitope recognized by melanoma-reactive CD4(+) T cells. Proc Natl Acad Sci U S A. Jan. 4, 2000;97(1):400-5. doi: 10.1073/pnas.97.1.400.
Zeltins, A., Construction and characterization of virus-like particles: a review. Mol Biotechnol. Jan. 2013;53(1):92-107. doi: 10.1007/s12033-012-9598-4.
Zeng et al., Therapeutic base editing of human hematopoietic stem cells. Nat Med. Apr. 2020;26(4):535-541. doi: 10.1038/s41591-020-0790-y. Epub Mar. 16, 2020.
Zhang et al., Adenine Base Editing In Vivo with a Single Adeno-Associated Virus Vector. BioRxiv. Dec. 13, 2021. DOI: 10.1101/2021.12.13.472434. Retrieved from https://www.biorxiv.org/content/10.1101/2021.12.13.472434v1.full on Aug. 1, 2023. 47 pages.
Zhang et al., Cell-specific targeting of lentiviral vectors mediated by fusion proteins derived from Sindbis virus, vesicular stomatitis virus, or avian sarcoma/leukosis virus. Retrovirology. Jan. 25, 2010;7:3. doi: 10.1186/1742-4690-7-3.
Zhang et al., CRISPR-Cpf1 correction of muscular dystrophy mutations in human cardiomyocytes and mice. Sci Adv. Apr. 12, 2017;3(4):e1602814. doi: 10.1126/sciadv.1602814.

(56) References Cited

OTHER PUBLICATIONS

Zhang et al., Large genomic fragment deletions and insertions in mouse using CRISPR/Cas9. PLoS One. Mar. 24, 2015;10(3):e0120396. doi: 10.1371/journal.pone.0120396. 14 pages.
Zhang et al., Morphology and ultrastructure of retrovirus particles. AIMS Biophys. 2015;2(3):343-369. doi: 10.3934/biophy.2015.3.343. Epub Aug. 18, 2015. Author Manuscript. 33 pages.
Zhang et al., Propagated Perturbations from a Peripheral Mutation Show Interactions Supporting WW Domain Thermostability. Structure. Nov. 6, 2018;26(11):1474-1485.e5. doi: 10.1016/j.str.2018.07.014. Epub Sep. 6, 2018.
Zhang et al., Reconstitution of 5'-directed human mismatch repair in a purified system. Cell. Sep. 9, 2005;122(5):693-705. doi: 10.1016/j.cell.2005.06.027.
Zhao et al., Glycosylase base editors enable C-to-A and C-to-G base changes. Nat Biotechnol. Jan. 2021;39(1):35-40. doi: 10.1038/s41587-020-0592-2. Epub Jul. 20, 2020. Erratum in: Nat Biotechnol. Jan. 2021;39(1):115. doi: 10.1038/s41587-020-0648-3.
Zhao et al., Study on p21 gene knock out in G401 cell line by using CRISPR/Cas9 system. Tianjin Med J. Oct. 2016;44(10):1190-1194.
Zheng et al., A flexible split prime editor using truncated reverse transcriptase improves dual-AAV delivery in mouse liver. Mol Ther. Mar. 2, 2022;30(3):1343-1351. doi: 10.1016/j.ymthe.2022.01.005. Epub Jan. 5, 2022.
Zhi et al., Dual-AAV delivering split prime editor system for in vivo genome editing. Mol Ther. Jan. 5, 2022;30(1):283-294 and Supplemental Info. doi: 10.1016/j.ymthe.2021.07.011. Epub Jul. 2, 20211. 35 pages.
Zhong et al., Automated Continuous Evolution of Proteins in Vivo. ACS Synth Biol. Jun. 19, 2020;9(6):1270-1276. doi: 10.1021/acssynbio.0c00135. Epub May 12, 2020. Author Manuscript, 14 pages.
Zhong et al., Seven novel variants expand the spectrum of RPE65-related Leber congenital amaurosis in the Chinese population. Mol Vis. Mar. 18, 2019;25:204-214.
Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.
Zhuang et al., Increasing the efficiency and precision of prime editing with guide RNA pairs. Nat Chem Biol. Jan. 2022;18(1):29-37. doi: 10.1038/s41589-021-00889-1. Epub Oct. 28, 2021.
U.S. Appl. No. 17/767,777, filed Apr. 8, 2022, Liu et al.
U.S. Appl. No. 17/751,599, filed May 23, 2022, Liu et al.
U.S. Appl. No. 17/688,416, filed Mar. 7, 2022, Liu et al.
U.S. Appl. No. 17/692,925, filed Mar. 11, 2022, Liu et al.
U.S. Appl. No. 17/700,109, filed Mar. 21, 2022, Liu et al.
[No Author Listed], Mus musculus (Mouse). UniProtKB Accession No. P51908 (ABEC1_MOUSE). Oct. 1, 1996. 10 pages.
Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.
Asokan et al., The AAV vector toolkit: poised at the clinical crossroads. Mol Ther. Apr. 2012;20(4):699-708. doi: 10.1038/mt.2011.287. Epub Jan. 24, 2012.
Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.
Badran et al., In vivo continuous directed evolution. Curr Opin Chem Biol. Feb. 2015;24:1-10. doi: 10.1016/j.cbpa.2014.09.040. Epub Nov. 7, 2014.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Barmania et al., C-C chemokine receptor type five (CCR5): An emerging target for the control of HIV infection. Appl Transl Genom. May 26, 2013;2:3-16. doi: 10.1016/j.atg.2013.05.004.
Beaudry et al., Directed evolution of an RNA enzyme. Science. Jul. 31, 1992;257(5070):635-41. doi: 10.1126/science.1496376.
Bell et al., Ribozyme-catalyzed excision of targeted sequences from within RNAs. Biochemistry. Dec. 24, 2002;41(51):15327-33. doi: 10.1021/bi0267386.
Bentin, T., A ribozyme transcribed by a ribozyme. Artif DNA PNA XNA. Apr. 2011;2(2):40-42. doi: 10.4161/adna.2.2.16852.
Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Brierley et al., Viral RNA pseudoknots: versatile motifs in gene expression and replication. Nat Rev Microbiol. Aug. 2007;5(8):598-610. doi: 10.1038/nrmicro1704.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.
Chen et al., Alterations in PMS2, MSH2 and MLH1 expression in human prostate cancer. Int J Oncol. May 2003;22(5):1033-43.
Chen et al., Enhanced prime editing systems by manipulating cellular determinants of editing outcomes. Cell. Oct. 28, 2021;184(22):5635-5652.e29. doi: 10.1016/j.cell.2021.09.018. Epub Oct. 14, 2021.
Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.
Davis et al., Assaying Repair at DNA Nicks. Methods Enzymol. 2018;601:71-89. doi: 10.1016/bs.mie.2017.12.001. Epub Feb. 1, 2018.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De La Peña et al., The Hammerhead Ribozyme: A Long History for a Short RNA. Molecules. Jan. 4, 2017;22(1):78. doi: 10.3390/molecules22010078.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.

(56) References Cited

OTHER PUBLICATIONS

Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Dolan et al., Trans-splicing with the group I intron ribozyme from Azoarcus. RNA. Feb. 2014;20(2):202-13. doi: 10.1261/rna.041012.113. Epub Dec. 16, 2013.
Doudna, The promise and challenge of therapeutic genome editing. Nature. Feb. 2020;578(7794):229-236. doi: 10.1038/s41586-020-1978-5. Epub Feb. 12, 2020.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Estacion et al., A sodium channel gene SCN9A polymorphism that increases nociceptor excitability. Ann Neurol. Dec. 2009;66(6):862-6. doi: 10.1002/ana.21895.
Ferreira Da Silva et al., Prime editing efficiency and fidelity are enhanced in the absence of mismatch repair. Nat Commun. Feb. 9, 2022;13(1):760. doi: 10.1038/s41467-022-28442-1.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.
Genbank Submission; NIH/NCBI Accession No. 4UN5_B. Anders et al., Jul. 23, 2014. 5 pages.
Genbank Submission; NIH/NCBI, Accession No. AIT42264.1. Hyun et al., Oct. 15, 2014. 2 pages.
Genbank Submission; NIH/NCBI, Accession No. AKA60242.1. Tong et al., Apr. 5, 2015. 1 page.
Genbank Submission; NIH/NCBI, Accession No. AKQ21048.1. Gilles et al., Jul. 19, 2015. 1 page.
Genbank Submission; NIH/NCBI, Accession No. AKS40380.1. Nodvig et al., Aug. 2, 2015. 1 page.
Genbank Submission; NIH/NCBI, Accession No. NG_008692.2. McClintock et al., Aug. 27, 2018. 33 pages.
Genbank Submission; NIH/NCBI, Accession No. NP_001075493.1. Schiaffella et al., Jun. 24, 2018. 2 pages.
Genbank Submission; NIH/NCBI, Accession No. NP_001157741.1. Zeng et al., Sep. 17, 2018. 3 pages.
Genbank Submission; NIH/NCBI, Accession No. NP_001157742.1. Zeng et al., Oct. 21, 2018. 3 pages.
Genbank Submission; NIH/NCBI, Accession No. NP_033040.2. Liu et al., Jun. 23, 2018. 2 pages.
Genbank Submission; NIH/NCBI, Accession No. WP_002989955.1. No Author Listed, May 6, 2013. 1 page.
Genbank Submission; NIH/NCBI, Accession No. WP_010922251.1. No Author Listed, May 15, 2013. 1 page.
Genbank Submission; NIH/NCBI, Accession No. WP_011054416.1. No Author Listed, May 15, 2013. 1 page.
Genbank Submission; NIH/NCBI, Accession No. WP_011284745.1. No Author Listed, May 16, 2013. 1 page.
Genbank Submission; NIH/NCBI, Accession No. WP_011285506.1. No Author Listed, May 16, 2013. 1 page.
Genbank Submission; NIH/NCBI, Accession No. WP_011527619.1. No Author Listed, May 16, 2013. 1 page.
Genbank Submission; NIH/NCBI, Accession No. WP_012560673.1. No Author Listed, May 17, 2013. 1 page.
Genbank Submission; NIH/NCBI, Accession No. WP_014407541.1. No Author Listed, May 18, 2013. 1 page.
Genbank Submission; NIH/NCBI, Accession No. WP_020905136.1. No Author Listed, Jul. 25, 2013. 1 page.
Genbank Submission; NIH/NCBI, Accession No. WP_023080005.1. No Author Listed, Oct. 27, 2013. 1 page.
Genbank Submission; NIH/NCBI, Accession No. WP_023610282.1. No Author Listed, Nov. 27, 2013. 1 page.
Genbank Submission; NIH/NCBI, Accession No. WP_030125963.1. No Author Listed, Jul. 9, 2014. 1 page.
Genbank Submission; NIH/NCBI, Accession No. WP_030126706.1. No Author Listed, Jul. 9, 2014. 1 page.
Genbank Submission; NIH/NCBI, Accession No. WP_031488318.1. No Author Listed., Aug. 5, 2014. 1 page.
Genbank Submission; NIH/NCBI, Accession No. WP_032460140.1. No Author Listed, Oct. 4, 2014. 1 page.
Genbank Submission; NIH/NCBI, Accession No. WP_032461047.1. No Author Listed, Oct. 4, 2014. 1 page.
Genbank Submission; NIH/NCBI, Accession No. WP_032462016.1. Haft et al., Oct. 4, 2014. 1 page.
Genbank Submission; NIH/NCBI, Accession No. WP_032462936.1. No Author Listed, Oct. 4, 2014. 1 page.
Genbank Submission; NIH/NCBI, Accession No. WP_032464890.1. No Author Listed, Oct. 4, 2014. 1 page.
Genbank Submission; NIH/NCBI, Accession No. WP_038431314.1. No Author Listed, Dec. 26, 2014. 1 page.
Genbank Submission; NIH/NCBI, Accession No. WP_038432938.1. No Author Listed, Dec. 26, 2014. 1 page.
Genbank Submission; NIH/NCBI, Accession No. WP_038434062.1. No Author Listed, Dec. 26, 2014. 1 page.
Genbank Submission; NIH/NCBI, Accession No. WP_048327215.1. No Author Listed, Jun. 26, 2015. 1 page.
Genbank Submission; NIH/NCBI, Accession No. WP_049519324.1. No Author Listed, Jul. 20, 2015. 1 page.
Genbank Submission; NIH/NCBI, Accession No. XP_003314669.1. No Author Listed, Mar. 20, 2018. 2 pages.
Genbank Submission; NIH/NCBI, Accession No. XP_026671085.1. No Author Listed, Oct. 17, 2018. 1 page.
Guedon et al., Current gene therapy using viral vectors for chronic pain. Mol Pain. May 13, 2015;11:27. doi: 10.1186/s12990-015-0018-1.
Guo et al., Evolution of Tetrahymena ribozyme mutants with increased structural stability. Nat Struct Biol. Nov. 2002;9(11):855-61. doi: 10.1038/nsb850.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hardt et al.,Missense variants in hMLH1 identified in patients from the German HNPCC consortium and functional studies. Fam Cancer. Jun. 2011;10(2):273-84. doi: 10.1007/s10689-011-9431-4.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.
Hua et al., Expanding the base editing scope in rice by using Cas9 variants. Plant Biotechnol J. Feb. 2019;17(2):499-504. doi: 10.1111/pbi.12993. Epub Oct. 5, 2018.
Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.
Isaacs et al., Engineered riboregulators enable post-transcriptional control of gene expression. Nat Biotechnol. Jul. 2004;22(7):841-7. doi: 10.1038/nbt986. Epub Jun. 20, 2004.

(56) References Cited

OTHER PUBLICATIONS

Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.
Johnson et al., Trans insertion-splicing: ribozyme-catalyzed insertion of targeted sequences into RNAs. Biochemistry. Aug. 9, 2005;44(31):10702-10. doi: 10.1021/bi0504815.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.
Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kumar et al., Gene therapy for chronic neuropathic pain: how does it work and where do we stand today? Pain Med. May 2011;12(5):808-22. doi: 10.1111/j.1526-4637.2011.01120.x.
Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.
Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Liao et al., One-step assembly of large CRISPR arrays enables multi-functional targeting and reveals constraints on array design. bioRxiv. May 2, 2018. doi: 10.1101/312421. 45 pages.
Liefke et al., The oxidative demethylase ALKBH3 marks hyperactive gene promoters in human cancer cells. Genome Med. Jun. 30, 2015;7(1):66. doi: 10.1186/s13073-015-0180-0.
Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.
Lindahl, T., Instability and decay of the primary structure of DNA. Nature. Apr. 22, 1993;362(6422):709-15. doi: 10.1038/362709a0.
Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.
Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.
Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.
Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.
Martz, L., Nav-i-gating antibodies for pain. Science-Business eXchange. Jun. 12, 2014;7(662):1-2. doi: 10.1038/scibx.2014.662.
Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.
Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.
Mootz et al., Protein splicing triggered by a small molecule. J Am Chem Soc. Aug. 7, 2002;124(31):9044-5 and Supporting Information. doi: 10.1021/ja0267690. 4 pages.
Muller, U.F., Design and Experimental Evolution of trans-Splicing Group I Intron Ribozymes. Molecules. Jan. 2, 2017;22(1):75. doi: 10.3390/molecules22010075.
Nelson et al., Engineered pegRNAs improve prime editing efficiency. Nat Biotechnol. Oct. 4, 2021. doi: 10.1038/s41587-021-01039-7. Epub ahead of print. Erratum in: Nat Biotechnol. Dec. 8, 2021. 14 pages.
Nelson et al., The unstable repeats—three evolving faces of neurological disease. Neuron. Mar. 6, 2013;77(5):825-43. doi: 10.1016/j.neuron.2013.02.022.
Noack et al., Epitranscriptomics: A New Regulatory Mechanism of Brain Development and Function. Front Neurosci. Feb. 20, 2018;12:85. doi: 10.3389/fnins.2018.00085. 9 pages.
Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.
Perreault et al., Mixed deoxyribo- and ribo-oligonucleotides with catalytic activity. Nature. Apr. 5, 1990;344(6266):565-7. doi: 10.1038/344565a0.
Pieken et al., Kinetic characterization of ribonuclease-resistant 2'-modified hammerhead ribozymes. Science. Jul. 19, 1991;253(5017):314-7. doi: 10.1126/science.1857967.
Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.
Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.
Raillard et al., Targeting sites within HIV-1 cDNA with a DNA-cleaving ribozyme. Biochemistry. Sep. 10, 1996;35(36):11693-701. doi: 10.1021/bi960845g.
Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.
Richardson et al., Frequent chromosomal translocations induced by DNA double-strand breaks. Nature. Jun. 8, 2000;405(6787):697-700. doi: 10.1038/35015097.
Robertson et al., Selection in vitro of an RNA enzyme that specifically cleaves single-stranded DNA. Nature. Mar. 29, 1990;344(6265):467-8. doi: 10.1038/344467a0.
Safari et al., CRISPR Cpf1 proteins: structure, function and implications for genome editing. Cell Biosci. May 9, 2019;9:36. doi: 10.1186/s13578-019-0298-7.
Samanta et al., A reverse transcriptase ribozyme. Elife. Sep. 26, 2017;6:e31153. doi: 10.7554/eLife.31153.
San Filippo et al., Mechanism of eukaryotic homologous recombination. Annu Rev Biochem. 2008;77:229-57. doi: 10.1146/annurev.biochem.77.061306.125255.
Schlacher et al., Double-strand break repair-independent role for BRCA2 in blocking stalled replication fork degradation by MRE11.

(56) References Cited

OTHER PUBLICATIONS

Cell. May 13, 2011;145(4):529-42. doi: 10.1016/j.cell.2011.03.041. Erratum in: Cell. Jun. 10, 2011;145(6):993.
Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for Shimomura et al., Complete Genome Sequencing and Analysis of a Lancefield Group G RT *Streptococcus dysgalactiae* Subsp. Equisimilis Strain Causing Streptococcal RT Toxic Shock Syndrome (STSS). RL BMC Genomics. 2011;12:17-17. 3 pages.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.
Shen et al., Efficient genome modification by CRISPR-Cas9 nickase with minimal off-target effects. Nat Methods. Apr. 2014; 11(4):399-402. doi: 10.1038/nmeth.2857. Epub Mar. 2, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.
Song et al., RS-1 enhances CRISPR/Cas9- and TALEN-mediated knock-in efficiency. Nat Commun. Jan. 28, 2016;7:10548. doi: 10.1038/ncomms10548.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Sullenger et al., Ribozyme-mediated repair of defective mRNA by targeted, trans-splicing. Nature. Oct. 13, 1994;371(6498):619-22. doi: 10.1038/371619a0.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Trojan et al., Functional analysis of hMLH1 variants and HNPCC-related mutations using a human expression system. Gastroenterology. Jan. 2002;122(1):211-9. doi: 10.1053/gast.2002.30296.
Tsai et al., GUIDE-seq enables genome-wide profiling of off-target cleavage by CRISPR-Cas nucleases. Nat Biotechnol. Feb. 2015;33(2):187-197. doi: 10.1038/nbt.3117. Epub Dec. 16, 2014.
Usman et al., Exploiting the chemical synthesis of RNA. Trends Biochem Sci. Sep. 1992;17(9):334-9. doi: 10.1016/0968-0004(92)90306-t.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 20200.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.
Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yu et al., Dynamic control of Rad51 recombinase by self-association and interaction with BRCA2. Mol Cell. Oct. 2003;12(4):1029-41. doi: 10.1016/s1097-2765(03)00394-0.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhou et al., Cas12a variants designed for lower genome-wide off-target effect through stringent PAM recognition. Mol Ther. Jan. 5, 2022;30(1):244-255. doi: 10.1016/j.ymthe.2021.10.010. Epub Oct. 20, 2021.
Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
[No Author Listed], Larimar Therapeutics Provides Update on CTI-1601 Clinical Program. Larimar Therapeutics, Inc. Feb. 14, 2022. Accessed Jun. 9, 2025 from <https://investors.larimartx.com/news-releases/news-release-details/larimar-therapeutics-provides-update-cti-1601-clinical-program>. 2 pages.
Al-Mahdawi et al., Large Interruptions of GAA Repeat Expansion Mutations in Friedreich Ataxia Are Very Rare. Front Cell Neurosci. Nov. 21, 2018;12:443. doi: 10.3389/fncel.2018.00443.
Bandiera et al., Genetic variations creating microRNA target sites in the FXN 3'-UTR affect frataxin expression in Friedreich ataxia. PLoS One. 2013;8(1):e54791. doi: 10.1371/journal.pone.0054791. Epub Jan. 30, 2013.
Belbellaa et al., High Levels of Frataxin Overexpression Lead to Mitochondrial and Cardiac Toxicity in Mouse Models. Mol Ther Methods Clin Dev. Sep. 1, 2020;19:120-138. doi: 10.1016/j.omtm.2020.08.018.
Berríos et al., Controllable genome editing with split-engineered base editors. Nat Chem Biol. Dec. 2021;17(12):1262-1270. doi: 10.1038/s41589-021-00880-w. Epub Oct. 18, 2021.
Bidichandani et al., Friedreich Ataxia. Dec. 18, 1998 [updated Apr. 10, 2025]. In: Adam MP, Feldman J, Mirzaa GM, Pagon RA, Wallace SE, Amemiya A, editors. GeneReviews® [Internet]. Seattle (WA): University of Washington, Seattle; 1993-2025. 41 pages.

(56) References Cited

OTHER PUBLICATIONS

Blum et al., Phage-assisted evolution of botulinum neurotoxin proteases with reprogrammed specificity. Science. Feb. 19, 2021;371(6531):803-810. doi: 10.1126/science.abf5972.
Brödel et al., Accelerated evolution of a minimal 63-amino acid dual transcription factor. Sci Adv. Jun. 10, 2020;6(24):eaba2728. doi: 10.1126/sciadv.aba2728.
Bryson et al., Continuous directed evolution of aminoacyl-tRNA synthetases. Nat Chem Biol. Dec. 2017;13(12):1253-1260. doi: 10.1038/nchembio.2474. Epub Oct. 16, 2017. Erratum in: Nat Chem Biol. Jan. 16, 2018;14(2):186. doi: 10.1038/nchembio0218-186.
Canver et al., BCL11A enhancer dissection by Cas9-mediated in situ saturating mutagenesis. Nature. Nov. 12, 2015;527(7577):192-7. doi: 10.1038/nature15521. Epub Sep. 16, 2015.
Chandran et al., Inducible and reversible phenotypes in a novel mouse model of Friedreich's Ataxia. Elife. Dec. 19, 2017;6:e30054. doi: 10.7554/eLife.30054.
Chelico et al., APOBEC3G Dna deaminase acts processively 3' --> 5' on single-stranded DNA. Nat Struct Mol Biol. May 2006;13(5):392-9. doi: 10.1038/nsmb1086. Epub Apr. 23, 2006.
Chen et al., Targeted activation of diverse CRISPR-Cas systems for mammalian genome editing via proximal CRISPR targeting. Nat Commun. Apr. 7, 2017;8:14958. doi: 10.1038/ncomms14958.
Chester et al., Optimization of apolipoprotein B mRNA editing by APOBEC1 apoenzyme and the role of its auxiliary factor, ACF. RNA. Sep. 2004;10(9):1399-411. doi: 10.1261/rna.7490704. Epub Jul. 23, 2004.
Cho et al., Targeted A-to-G base editing in human mitochondrial DNA with programmable deaminases. Cell. May 12, 2022;185(10):1764-1776.e12. doi: 10.1016/j.cell.2022.03.039. Epub Apr. 25, 2022.
Cinesi et al., Contracting CAG/CTG repeats using the CRISPR-Cas9 nickase. Nat Commun. Nov. 9, 2016;7:13272. doi: 10.1038/ncomms13272. Erratum in: Nat Commun. Oct. 17, 2024;15(1):8951. doi: 10.1038/s41467-024-52719-2.
Clark et al., Expansion of GAA triplet repeats in the human genome: unique origin of the FRDA mutation at the center of an Alu. Genomics. Mar. 2004;83(3):373-83. doi: 10.1016/j.ygeno.2003.09.001.
Cnop et al., Diabetes in Friedreich ataxia. J Neurochem. Aug. 2013;126 Suppl 1:94-102. doi: 10.1111/jnc.12216.
Cook et al., Friedreich's ataxia: clinical features, pathogenesis and management. Br Med Bull. Dec. 1, 2017;124(1):19-30. doi: 10.1093/bmb/ldx034.
Cuella-Martin et al., Functional interrogation of DNA damage response variants with base editing screens. Cell. Feb. 18, 2021;184(4):1081-1097.e19. doi: 10.1016/j.cell.2021.01.041.
Dabrowska et al., Precise Excision of the CAG Tract from the Huntingtin Gene by Cas9 Nickases. Front Neurosci. Feb. 26, 2018;12:75. doi: 10.3389/fnins.2018.00075.
De Biase et al., Progressive GAA expansions in dorsal root ganglia of Friedreich's ataxia patients. Ann Neurol. Jan. 2007;61(1):55-60. doi: 10.1002/ana.21052.
Delatycki et al., Friedreich ataxia-pathogenesis and implications for therapies. Neurobiol Dis. Dec. 2019;132:104606. doi: 10.1016/j.nbd.2019.104606. Epub Sep. 5, 2019.
Eisenstein et al., Base editing marches on the clinic. Nat Biotechnol. May 2022;40(5):623-625. doi: 10.1038/s41587-022-01326-x.
Enache et al., Cas9 activates the p53 pathway and selects for p53-inactivating mutations. Nat Genet. Jul. 2020;52(7):662-668. doi: 10.1038/s41588-020-0623-4. Epub May 18, 2020. Erratum in: Nat Genet. Jul. 2020;52(7):748-749. doi: 10.1038/s41588-020-0663-9.
Esashi et al., Stabilization of RAD51 nucleoprotein filaments by the C-terminal region of BRCA2. Nat Struct Mol Biol. Jun. 2007;14(6):468-74. doi: 10.1038/nsmb1245. Epub May 21, 2007.
Fisher et al., Transduction with recombinant adeno-associated virus for gene therapy is limited by leading-strand synthesis. J Virol. Jan. 1996;70(1):520-32. doi: 10.1128/JVI.70.1.520-532.1996.
Fishman-Lobell et al., Two alternative pathways of double-strand break repair that are kinetically separable and independently modulated. Mol Cell Biol. Mar. 1992;12(3):1292-303. doi: 10.1128/mcb.12.3.1292-1303.1992.
Greene et al., Repeat-induced epigenetic changes in intron 1 of the frataxin gene and its consequences in Friedreich ataxia. Nucleic Acids Res. 2007;35(10):3383-90. doi: 10.1093/nar/gkm271. Epub May 3, 2007.
Grimm et al., Helper virus-free, optically controllable, and two-plasmid-based production of adeno-associated virus vectors of serotypes 1 to 6. Mol Ther. Jun. 2003;7(6):839-50. doi: 10.1016/s1525-0016(03)00095-9.
Grimm et al., Novel tools for production and purification of recombinant adenoassociated virus vectors. Hum Gene Ther. Dec. 10, 1998;9(18):2745-60. doi: 10.1089/hum.1998.9.18-2745.
Grünewald et al., A dual-deaminase CRISPR base editor enables concurrent adenine and cytosine editing. Nat Biotechnol. Jul. 2020;38(7):861-864. doi: 10.1038/s41587-020-0535-y. Epub Jun. 1, 2020.
Grünewald et al., CRISPR DNA base editors with reduced RNA off-target and self-editing activities. Nat Biotechnol. Sep. 2019;37(9):1041-1048. doi: 10.1038/s41587-019-0236-6. Epub Sep. 2, 2019.
Hu et al., A compact Cas9 ortholog from *Staphylococcus auricularis* (SauriCas9) expands the DNA targeting scope. PLoS Biol. Mar. 30, 2020;18(3):e3000686. doi: 10.1371/journal.pbio.3000686.
Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015.
Huichalaf et al., In vivo overexpression of frataxin causes toxicity mediated by iron-sulfur cluster deficiency. Mol Ther Methods Clin Dev. Feb. 7, 2022;24:367-378. doi: 10.1016/j.omtm.2022.02.002.
Jeong et al., Adenine base editor engineering reduces editing of bystander cytosines. Nat Biotechnol. Nov. 2021;39(11):1426-1433. doi: 10.1038/s41587-021-00943-2. Epub Jul. 1, 2021.
Jeong et al., Construction of non-canonical PAM-targeting adenosine base editors by restriction enzyme-free DNA cloning using CRISPR-Cas9. Sci Rep. Mar. 20, 2019;9(1):4939. doi: 10.1038/s41598-019-41356-1.
Jiralerspong et al., Frataxin shows developmentally regulated tissue-specific expression in the mouse embryo. Neurobiol Dis. 1997;4(2):103-13. doi: 10.1006/nbdi.1997.0139.
Johnson et al., Therapeutic landscape for Batten disease: current treatments and future prospects. Nat Rev Neurol. Mar. 2019;15(3):161-178. doi: 10.1038/s41582-019-0138-8.
Johnston et al., Continuous bioactivity-dependent evolution of an antibiotic biosynthetic pathway. Nat Commun. Aug. 21, 2020;11(1):4202. doi: 10.1038/s41467-020-18018-2.
Jones et al., Phage-Assisted Continuous Evolution and Selection of Enzymes for Chemical Synthesis. ACS Cent Sci. Sep. 22, 2021;7(9):1581-1590. doi: 10.1021/acscentsci.1c00811. Epub Sep. 13, 2021.
Jumper et al., Highly accurate protein structure prediction with AlphaFold. Nature. Aug. 2021;596(7873):583-589. doi: 10.1038/s41586-021-03819-2. Epub Jul. 15, 2021.
Kacher et al., Propensity for somatic expansion increases over the course of life in Huntington disease. Elife. May 13, 2021;10:e64674. doi: 10.7554/eLife.64674.
Kantor et al., CRISPR-Cas9 DNA Base-Editing and Prime-Editing. Int J Mol Sci. Aug. 28, 2020;21(17):6240. doi: 10.3390/ijms21176240.
Kawakami, K., Tol2: a versatile gene transfer vector in vertebrates. Genome Biol. 2007;8 Suppl 1(Suppl 1):S7. doi: 10.1186/GB-2007-8-s1-s7.
Kern et al., Identification of a heparin-binding motif on adeno-associated virus type 2 capsids. J Virol. Oct. 2003;77(20):11072-81. doi: 10.1128/jvi.77.20.11072-11081.2003.
Khristich et al., Large-scale contractions of Friedreich's ataxia GAA repeats in yeast occur during DNA replication due to their triplex-forming ability. Proc Natl Acad Sci U S A. Jan. 21, 2020;117(3):1628-1637. doi: 10.1073/pnas.1913416117. Epub Jan. 7, 2020.

(56) References Cited

OTHER PUBLICATIONS

Kronenberg et al., A conformational change in the adeno-associated virus type 2 capsid leads to the exposure of hidden VP1 N termini. J Virol. May 2005;79(9):5296-303. doi: 10.1128/JVI.79.9.5296-5303.2005.
Lazaropoulos et al., Frataxin levels in peripheral tissue in Friedreich ataxia. Ann Clin Transl Neurol. Aug. 2015;2(8):831-42. doi: 10.1002/acn3.225. Epub Jul. 1, 2015.
Leonard et al., CDKL5 deficiency disorder: clinical features, diagnosis, and management. Lancet Neurol. Jun. 2022;21(6):563-576. doi: 10.1016/S1474-4422(22)00035-7. Epub Apr. 25, 2022.
Li et al., Excision of Expanded GAA Repeats Alleviates the Molecular Phenotype of Friedreich's Ataxia. Mol Ther. Jun. 2015;23(6):1055-1065. doi: 10.1038/mt.2015.41. Epub Mar. 11, 2015.
Li et al., Excision of the expanded GAA repeats corrects cardiomyopathy phenotypes of iPSC-derived Friedreich's ataxia cardiomyocytes. Stem Cell Res. Oct. 2019;40:101529. doi: 10.1016/j.scr.2019.101529. Epub Aug. 7, 2019.
Li et al., Targeted, random mutagenesis of plant genes with dual cytosine and adenine base editors. Nat Biotechnol. Jul. 2020;38(7):875-882. doi: 10.1038/s41587-019-0393-7. Epub Jan. 13, 2020.
Liang et al., AGBE: a dual deaminase-mediated base editor by fusing CGBE with ABE for creating a saturated mutant population with multiple editing patterns. Nucleic Acids Res. May 20, 2022;50(9):5384-5399. doi: 10.1093/nar/gkac353.
Liu et al., DNA base excision repair: a mechanism of trinucleotide repeat expansion. Trends Biochem Sci. Apr. 2012;37(4):162-72. doi: 10.1016/j.tibs.2011.12.002. Epub Jan. 27, 2012.
Long et al., Somatic instability of the expanded GAA repeats in Friedreich's ataxia. PLoS One. Dec. 19, 2017;12(12):e0189990. doi: 10.1371/journal.pone.0189990.
Ma et al., Generation of pathogenic TPP1 mutations in human stem cells as a model for neuronal ceroid lipofuscinosis type 2 disease. Stem Cell Res. May 2021;53:102323. doi: 10.1016/j.scr.2021.102323. Epub Apr. 6, 2021.
Massey et al., The central role of DNA damage and repair in CAG repeat diseases. Dis Model Mech. Jan. 30, 2018;11(1):dmm031930. doi: 10.1242/dmm.031930.
Mazzara et al., Frataxin gene editing rescues Friedreich's ataxia pathology in dorsal root ganglia organoid-derived sensory neurons. Nat Commun. Aug. 21, 2020;11(1):4178. doi: 10.1038/s41467-020-17954-3.
Miller et al., Cell-surface receptors for retroviruses and implications for gene transfer. Proc Natl Acad Sci U S A. Oct. 15, 1996;93(21):11407-13. doi: 10.1073/pnas.93.21.11407.
Mingozzi, F., Immunogenicity: A Matter of Sensitivity. Mol Ther. Oct. 3, 2018;26(10):2335-2336. doi: 10.1016/j.ymthe.2018.09.001. Epub Sep. 18, 2018.
Monteys et al., CRISPR/Cas9 Editing of the Mutant Huntingtin Allele In Vitro and In Vivo. Mol Ther. Jan. 4, 2017;25(1):12-23. doi: 10.1016/j.ymthe.2016.11.010. Epub Jan. 4, 2017.
Moullier et al., International efforts for recombinant adeno-associated viral vector reference standards. Mol Ther. Jul. 2008;16(7):1185-8. doi: 10.1038/mt.2008.125.
Naryshkin et al., Motor neuron disease. SMN2 splicing modifiers improve motor function and longevity in mice with spinal muscular atrophy. Science. Aug. 8, 2014;345(6197):688-93. doi: 10.1126/science.1250127.
Neil et al., Replication-independent instability of Friedreich's ataxia GAA repeats during chronological aging. Proc Natl Acad Sci U S A. Feb. 2, 2021;118(5):e2013080118. doi: 10.1073/pnas.2013080118.
Nethisinghe et al., Interruptions of the FXN GAA Repeat Tract Delay the Age at Onset of Friedreich's Ataxia in a Location Dependent Manner. Int J Mol Sci. Jul. 13, 2021;22(14):7507. doi: 10.3390/ijms22147507.
Niu et al., Inactivation of porcine endogenous retrovirus in pigs using CRISPR-Cas9. Science. Sep. 22, 2017;357(6357):1303-1307. doi: 10.1126/science.aan4187. Epub Aug. 10, 2017.
Ohshima et al., A nonpathogenic GAAGGA repeat in the Friedreich gene: implications for pathogenesis. Neurology. Nov. 10, 1999;53(8):1854-7. doi: 10.1212/wnl.53.8.1854.
Oura et al., CAG repeat contraction in a Huntington's Disease mouse model is enabled by gene editing with SpCas9-NG. Commun Biol. Jun. 23, 2021;4(1):771. doi: 10.1038/s42003-021-02304-W.
Pandolfo, M., Friedreich ataxia: new pathways. J Child Neurol. Sep. 2012;27(9):1204-11. doi: 10.1177/0883073812448534. Epub Jun. 29, 2012.
Park et al., Off-Target Editing by CRISPR-Guided DNA Base Editors. Biochemistry. Sep. 10, 2019;58(36):3727-3734. doi: 10.1021/acs.biochem.9b00573. Epub Aug. 26, 2019.
Pettersen et al., UCSF Chimera—a visualization system for exploratory research and analysis. J Comput Chem. Oct. 2004;25(13):1605-12. doi: 10.1002/jcc.20084.
Pickar-Oliver et al., The next generation of CRISPR-Cas technologies and applications. Nat Rev Mol Cell Biol. Aug. 2019;20(8):490-507. doi: 10.1038/s41580-019-0131-5.
Pinto et al., Patterns of CAG repeat instability in the central nervous system and periphery in Huntington's disease and in spinocerebellar ataxia type 1. Hum Mol Genet. Aug. 29, 2020;29(15):2551-2567. doi: 10.1093/hmg/ddaa139.
Punga et al., Long intronic GAA repeats causing Friedreich ataxia impede transcription elongation. EMBO Mol Med. Apr. 2010;2(4):120-9. doi: 10.1002/emmm.201000064.
Puspasari et al., Long range regulation of human FXN gene expression. PLoS One. 2011;6(7):e22001. doi: 10.1371/journal.pone.0022001. Epub Jul. 8, 2011.
Qiao et al., Recognizes Structured DNA for Class Switch Recombination. Mol Cell. Aug. 3, 2017;67(3):361-373.e4. doi: 10.1016/j.molcel.2017.06.034. Epub Jul. 27, 2017.
Reetz et al., Biological and clinical characteristics of the European Friedreich's Ataxia Consortium for Translational Studies (EFACTS) cohort: a cross-sectional analysis of baseline data. Lancet Neurol. Feb. 2015;14(2):174-82. doi: 10.1016/S1474-4422(14)70321-7. Epub Jan. 5, 2015.
Rocca et al., CRISPR-Cas9 Gene Editing of Hematopoietic Stem Cells from Patients with Friedreich's Ataxia. Mol Ther Methods Clin Dev. May 3, 2020;17:1026-1036. doi: 10.1016/j.omtm.2020.04.018.
Rolfsmeier et al., Stabilizing effects of interruptions on trinucleotide repeat expansions in *Saccharomyces cerevisiae*. Mol Cell Biol. Jan. 2000;20(1):173-80. doi: 10.1128/MCB.20.1.173-180.2000.
Roth et al., Phage-Assisted Evolution of Bacillus methanolicus Methanol Dehydrogenase 2. ACS Synth Biol. Apr. 19, 2019;8(4):796-806. doi: 10.1021/acssynbio.8b00481. Epub Mar. 20, 2019.
Rudin et al., Efficient repair of HO-induced chromosomal breaks in *Saccharomyces cerevisiae* by recombination between flanking homologous sequences. Mol Cell Biol. Sep. 1988;8(9):3918-28. doi: 10.1128/mcb.8.9.3918-3928.1988.
Ryan et al., Phosphonoacetate Modifications Enhance the Stability and Editing Yields of Guide RNAs for Cas9 Editors. Biochemistry. Dec. 19, 2023;62(24):3512-3520. doi: 10.1021/acs.biochem.1c00768. Epub Apr. 18, 2022.
Sakamoto et al., GGA*TCC-interrupted triplets in long GAA*TTC repeats inhibit the formation of triplex and sticky DNA structures, alleviate transcription inhibition, and reduce genetic instabilities. J Biol Chem. Jul. 20, 2001;276(29):27178-87. doi: 10.1074/jbc.M101852200. Epub Apr. 26, 2001.
Sakata et al., Base editors for simultaneous introduction of C-to-T and A-to-G mutations. Nat Biotechnol. Jul. 2020;38(7):865-869. doi: 10.1038/s41587-020-0509-0. Epub Jun. 2, 2020. Erratum in: Nat Biotechnol. Jul. 2020;38(7):901. doi: 10.1038/s41587-020-0585-1.
Santos et al., Friedreich ataxia: molecular mechanisms, redox considerations, and therapeutic opportunities. Antioxid Redox Signal. Sep. 1, 2010;13(5):651-90. doi: 10.1089/ars.2009.3015.
Shin et al., Permanent inactivation of Huntington's disease mutation by personalized allele- specific CRISPR/Cas9. Hum Mol Genet. Oct. 15, 2016;25(20):4566-4576. doi: 10.1093/hmg/ddw286.
Shishkin et al., Large-scale expansions of Friedreich's ataxia GAA repeats in yeast. Mol Cell. Jul. 10, 2009;35(1):82-92. doi: 10.1016/j.molcel.2009.06.017.

(56) References Cited

OTHER PUBLICATIONS

Silva et al., Expanded GAA repeats impair FXN gene expression and reposition the FXN locus to the nuclear lamina in single cells. Hum Mol Genet. Jun. 15, 2015;24(12):3457-71. doi: 10.1093/hmg/ddv096. Epub Mar. 26, 2015.

Soragni et al., Long intronic GAA*TTC repeats induce epigenetic changes and reporter gene silencing in a molecular model of Friedreich ataxia. Nucleic Acids Res. Nov. 2008;36(19):6056-65. doi: 10.1093/nar/gkn604. Epub Sep. 27, 2008.

Swami et al., Somatic expansion of the Huntington's disease CAG repeat in the brain is associated with an earlier age of disease onset. Hum Mol Genet. Aug. 15, 2009;18(16):3039-47. doi: 10.1093/hmg/ddp242. Epub May 23, 2009.

Takahashi et al., Induction of pluripotent stem cells from mouse embryonic and adult fibroblast cultures by defined factors. Cell. Aug. 25, 2006;126(4):663-76. doi: 10.1016/j.cell.2006.07.024. Epub Aug. 10, 2006.

Tokuriki et al., Stability effects of mutations and protein evolvability. Curr Opin Struct Biol. Oct. 2009;19(5):596-604. doi: 10.1016/j.sbi.2009.08.003. Epub Sep. 16, 2009.

Wang et al., Efficient base editing in methylated regions with a human APOBEC3A-Cas9 fusion. Nat Biotechnol. Nov. 2018;36(10):946-949. doi: 10.1038/nbt.4198. Epub Aug. 20, 2018.

Worgall et al., Treatment of late infantile neuronal ceroid lipofuscinosis by CNS administration of a serotype 2 adeno-associated virus expressing CLN2 cDNA. Hum Gene Ther. May 2008;19(5):463-74. doi: 10.1089/hum.2008.022.

Wu et al., Highly efficient therapeutic gene editing of human hematopoietic stem cells. Nat Med. May 2019;25(5):776-783. doi: 10.1038/s41591-019-0401-y. Epub Mar. 25, 2019.

Xie et al., ACBE, a new base editor for simultaneous C-to-T and A-to-G substitutions in mammalian systems. BMC Biol. Sep. 23, 2020;18(1):131. doi: 10.1186/s12915-020-00866-5.

Xu et al., High-throughput mapping of a whole rhesus monkey brain at micrometer resolution. Nat Biotechnol. Dec. 2021;39(12):1521-1528. doi: 10.1038/s41587-021-00986-5. Epub Jul. 26, 2021.

Yang et al., CRISPR/Cas9-mediated gene editing ameliorates neurotoxicity in mouse model of Huntington's disease. J Clin Invest. Jun. 30, 2017;127(7):2719-2724. doi: 10.1172/JCI92087. Epub Jun. 19, 2017.

Yang et al., Time-dependent maturation of cationic liposome-DNA complex for serum resistance. Gene Ther. Mar. 1998;5(3):380-7. doi: 10.1038/sj.gt.3300596.

Zhang et al., Dual base editor catalyzes both cytosine and adenine base conversions in human cells. Nat Biotechnol. Jul. 2020;38(7):856-860. doi: 10.1038/s41587-020-0527-y. Epub Jun. 1, 2020.

[No Author Listed], *Homo sapiens* signal transducer and activator of transcription 3 (acute-phase response factor) (STAT3) gene, complete cds. GenBank Acc. No. AYS572796.1. Accessible at https://www.ncbi.nlm.nih.gov/nucleotide/AYS572796.1?report=genbank&log$=nuclalign&blast_rank=2&RID=BEG3KP4D014. Mar. 22, 2004. 36 pages.

[No Author Listed], NCT03872479: Single Ascending Dose Study in Participants With LCA10. Sep. 26, 2019. 15 pages. Accessed Sep. 18, 2025 from <https://clinicaltrials.gov/study/NCT03872479>.

[No Author Listed], NCT04601051: Study to Evaluate Safety, Tolerability, Pharmacokinetics, and Pharmacodynamics of NTLA-2001 in Patients With Hereditary Transthyretin Amyloidosis With Polyneuropathy (ATTRv-PN) and Patients With Transthyretin Amyloidosis-Related Cardiomyopathy (ATTR-CM). Nov. 5, 2020. 19 pages. Accessed Sep. 18, 2025 from <https://clinicaltrials.gov/study/NCT04601051>.

[No Author Listed], RAD51 isoform 3. Uniprot Accession No. A0A2J8S626. Mar. 28, 2018. Accessible at https://www.uniprot.org/uniprotkb/A0A2J8S626/entry. 7 pages.

Adamson et al., Approaches to maximize sgRNA-barcode coupling in Perturb-seq screens. bioRxiv preprint. Apr. 11, 2018. doi: 10.1101/298349. 14 pages.

Armbruster et al., Efficacy and biodistribution analysis of intracerebroventricular administration of an optimized scAAV9-SMN1 vector in a mouse model of spinal muscular atrophy. Mol Ther Methods Clin Dev. Sep. 14, 2016;3:16060. doi: 10.1038/mtm.2016.60.

Berg et al., Targeted sequencing reveals expanded genetic diversity of human transfer RNAs. RNA Biol. Nov. 2019;16(11):1574-1585. doi: 10.1080/15476286.2019.1646079. Epub Aug. 13, 2019.

Berg et al., Transfer RNAs: diversity in form and function. RNA Biol. Mar. 2021;18(3):316-339. doi: 10.1080/15476286.2020.1809197. Epub Sep. 9, 2020.

Burgess et al., Possible dissociation of the heparin-binding and mitogenic activities of heparin-binding (acidic fibroblast) growth factor-1 from its receptor-binding activities by site-directed mutagenesis of a single lysine residue. J Cell Biol. Nov. 1990;111(5 Pt 1):2129-38. doi: 10.1083/jcb.111.5.2129.

Buvoli et al., Suppression of nonsense mutations in cell culture and mice by multimerized suppressor tRNA genes. Mol Cell Biol. May 2000;20(9):3116-24. doi: 10.1128/MCB.20.9.3116-3124.2000.

Čavužić et al., Biosynthesis of Sulfur-Containing tRNA Modifications: A Comparison of Bacterial, Archaeal, and Eukaryotic Pathways. Biomolecules. Mar. 11, 2017;7(1):27. doi: 10.3390/biom7010027.

Chan et al., GtRNAdb 2.0: an expanded database of transfer RNA genes identified in complete and draft genomes. Nucleic Acids Res. Jan. 4, 2016;44(D1):D184-9. doi: 10.1093/nar/gkv1309. Epub Dec. 15, 2015.

Cheng et al., Essential role of mitochondrial Stat3 in p38MAPK mediated apoptosis under oxidative stress. Sci Rep. Nov. 13, 2017;7(1):15388. doi: 10.1038/s41598-017-15342-4. Erratum in: Sci Rep. Apr. 12, 2018;8(1):6119. doi: 10.1038/s41598-018-23431-1.

Chu et al., Rationally Designed Base Editors for Precise Editing of the Sickle Cell Disease Mutation. Crispr J. Apr. 2021;4(2): 169-177. doi: 10.1089/crispr.2020.0144.

Clarke et al., The effect of premature termination codon mutations on CFTR mRNA abundance in human nasal epithelium and intestinal organoids: a basis for read-through therapies in cystic fibrosis. Hum Mutat. Mar. 2019;40(3):326-334. doi: 10.1002/humu.23692. Epub Dec. 10, 2018.

Cofsky et al., CRISPR-Cas9 bends and twists DNA to read its sequence. Nat Struct Mol Biol. Apr. 2022;29(4):395-402. doi: 10.1038/s41594-022-00756-0. Epub Apr. 14, 2022.

Dewannieux et al., Identification of autonomous IAP LTR retrotransposons mobile in mammalian cells. Nat Genet. May 2004;36(5):534-9. doi: 10.1038/ng1353. Epub Apr. 25, 2004.

Duvoisin et al., Human U6 promoter drives stronger shRNA activity than its schistosome orthologue in Schistosoma mansoni and human fibrosarcoma cells. Transgenic Res. Jun. 2012;21(3):511-21. doi: 10.1007/s11248-011-9548-0. Epub Sep. 28, 2011.

Eid et al., CRISPR base editors: genome editing without double-stranded breaks. Biochem J. Jun. 11, 2018;475(11):1955-1964. doi: 10.1042/BCJ20170793.

Finkel et al., One-Time Intrathecal (IT) Administration of AVXS-101 IT Gene-Replacement Therapy for Spinal Muscular Atrophy: Phase 1 Study. Neurology. Apr. 14, 2020;94(15_Suppl). doi: 10.1212/WNL.94.15_supplement.249.

Frangoul et al., CRISPR-Cas9 Gene Editing for Sickle Cell Disease and B-Thalassemia. N Engl J Med. Jan. 21, 2021;384(3):252-260. doi: 10.1056/NEJMoa2031054. Epub Dec. 5, 2020.

Fry et al., RNA editing as a therapeutic approach for retinal gene therapy requiring long coding sequences. Int J Mol Sci. Jan. 25, 2020;21(3):777. doi: 10.3390/ijms21030777.

Garcia et al., Identification of the rate-determining step of tRNA-guanine transglycosylase from *Escherichia coli*. Biochemistry. Dec. 1, 2009;48(47):11243-51. doi: 10.1021/bi901501a.

Giegé et al., Universal rules and idiosyncratic features in tRNA identity. Nucleic Acids Res. Nov. 15, 1998;26(22):5017-35. doi: 10.1093/nar/26.22.5017.

Goldstein et al., The tangled bank of amino acids. Protein Sci. Jul. 2016;25(7):1354-62. doi: 10.1002/pro.2930. Epub May 12, 2016.

Gutmann et al., Harnessing preclinical mouse models to inform human clinical cancer trials. J Clin Invest. Apr. 2006;116(4):847-52. doi: 10.1172/JCI28271.

(56) References Cited

OTHER PUBLICATIONS

Han et al., C2H2 Zinc Finger Proteins: Master Regulators of Abiotic Stress Responses in Plants. Front Plant Sci. Feb. 20, 2020;11:115. doi: 10.3389/fpls.2020.00115. Erratum in: Front Plant Sci. Mar. 18, 2020;11:298. doi: 10.3389/fpls.2020.00298.
Himeno et al., Only one nucleotide insertion to the long variable arm confers an efficient serine acceptor activity upon Saccharomyces cerevisiae tRNA(Leu) in vitro. J Mol Biol. May 16, 1997;268(4):704-11. doi: 10.1006/jmbi.1997.0991.
Hirakawa et al., Gene editing and CRISPR in the clinic: current and future perspectives. Biosci Rep. Apr. 30, 2020;40(4):BSR20200127. doi: 10.1042/BSR20200127.
Hong et al., Mechanism of tRNA-mediated +1 ribosomal frameshifting. Proc Natl Acad Sci U S A. Oct. 30, 2018;115(44):11226-11231. doi: 10.1073/pnas.1809319115. Epub Sep. 27, 2018.
Hou et al., Retrotransposon vectors for gene delivery in plants. Mob DNA. Aug. 2, 2010;1(1):19. doi: 10.1186/1759-8753-1-19.
Iascone et al., Spinal muscular atrophy: from tissue specificity to therapeutic strategies. F1000Prime Rep. Jan. 5, 2015;7:04. doi: 10.12703/P7-04.
Iben et al., tRNA gene copy number variation in humans. Gene. Feb. 25, 2014;536(2):376-84. doi: 10.1016/j.gene.2013.11.049. Epub Dec. 14, 2013.
Isgrig et al., Gene Therapy Restores Balance and Auditory Functions in a Mouse Model of Usher Syndrome. Mol Ther. Mar. 1, 2017;25(3):780-791. doi: 10.1016/j.ymthe.2017.01.007. Epub Feb. 21, 2017. Erratum in: Mol Ther. Feb. 2, 2022;30(2):975. doi: 10.1016/j.ymthe.2022.01.026.
Jo et al., CRISPR-Cas9-mediated therapeutic editing of Rpe65 ameliorates the disease phenotypes in a mouse model of Leber congenital amaurosis. Sci Adv. Oct. 30, 2019;5(10):eaax1210. doi: 10.1126/sciadv.aax1210.
Karijolich et al., Therapeutic suppression of premature termination codons: mechanisms and clinical considerations (review). Int J Mol Med. Aug. 2014;34(2):355-62. doi: 10.3892/ijmm.2014.1809. Epub Jun. 17, 2014.
Krishnamurthy et al., Functional correction of CFTR mutations in human airway epithelial cells using adenine base editors. Nucleic Acids Res. Oct. 11, 2021;49(18):10558-10572. doi: 10.1093/nar/gkab788.
Kuzmin et al., The clinical landscape for AAV gene therapies. Nat Rev Drug Discov. Mar. 2021;20(3):173-174. doi: 10.1038/d41573-021-00017-7.
Lant et al., Pathways to disease from natural variations in human cytoplasmic tRNAs. J Biol Chem. Apr. 5, 2019;294(14):5294-5308. doi: 10.1074/jbc.REV118.002982. Epub Jan. 14, 2019.
Lin et al., Structure-function relationships in glucagon: properties of highly purified des-His-1-, monoiodo-, and (des-Asn-28, Thr-29)(homoserine lactone-27)-glucagon. Biochemistry. Apr. 22, 1975;14(8):1559-63. doi: 10.1021/bi00679a002.
Ma et al., A new mutation in BFSP2 (G1091A) causes autosomal dominant congenital lamellar cataracts. Mol Vis. 2008;14:1906-11. Epub Oct. 24, 2008.
Ma et al., Highly efficient and precise base editing by engineered dCas9-guide tRNA adenosine deaminase in rats. Cell Discov. Jul. 17, 2018;4:39. doi: 10.1038/s41421-018-0047-9.
Mauriac et al., A hop, skip, and a jump to evade USH2A deaf-blindness mutations. Mol Ther. Aug. 4, 2021;29(8):2391-2393. doi: 10.1016/j.ymthe.2021.07.008. Epub Jul. 23, 2021.
Métais et al., Genome editing of HBG1 and HBG2 to induce fetal hemoglobin. Blood Adv. Nov. 12, 2019;3(21):3379-3392. doi: 10.1182/bloodadvances.2019000820.
Meyer et al., Improving single injection CSF delivery of AAV9-mediated gene therapy for SMA: a dose-response study in mice and nonhuman primates. Mol Ther. Mar. 2015;23(3):477-87. doi: 10.1038/mt.2014.210. Epub Oct. 31, 2014.
Mohr et al., Dominant-negative activity of the STAT3-Y705F mutant depends on the N- terminal domain. Cell Commun Signal. Nov. 5, 2013;11:83. doi: 10.1186/1478-811X-11-83.
Mort et al., A meta-analysis of nonsense mutations causing human genetic disease. Hum Mutat. Aug. 2008;29(8):1037-47. doi: 10.1002/humu.20763.
Nonekowski et al., The *Escherichia coli* tRNA-guanine transglycosylase can recognize and modify Dna. J Biol Chem. Mar. 1, 2002;277(9):7178-82. doi: 10.1074/jbc.M111077200. Epub Dec. 21, 2001.
Nunez et al., Chemical and Biophysical Modulation of Cas9 for Tunable Genome Engineering. ACS Chem Biol. Mar. 18, 2016;11(3):681-8. doi: 10.1021/acschembio.5b01019. Epub Feb. 9, 2016.
Perkel, J.M., Crispr Is Still on Point When It Comes to Genome Editing. Biocompare. Jun. 2, 2016. Accessed from < https://www.biocompare.com/Editorial-Articles/187183-CRISPR-Is-Still-on-Point-When-It-Comes-to-Genome-Editing/>. 8 pages.
Piccioni et al., Pooled Lentiviral-Delivery Genetic Screens. Curr Protoc Mol Biol. Jan. 16, 2018;121:32.1.1-32.1.21. doi: 10.1002/cpmb.52.
Ponting, C.P., Biological function in the twilight zone of sequence conservation. BMC Biol. Aug. 16, 2017;15(1):71. doi: 10.1186/s12915-017-0411-5.
Preece et al., 'Mini' U6 Pol III promoter exhibits nucleosome redundancy and supports multiplexed coupling of CRISPR/Cas9 effects. Gene Ther. Sep. 2020;27(9):451-458. doi: 10.1038/s41434-020-0142-z. Epub Mar. 20, 2020.
Reeck et al., "Homology" in proteins and nucleic acids: a terminology muddle and a way out of it. Cell. Aug. 28, 1987;50(5):667. doi: 10.1016/0092-8674(87)90322-9.
Ribet et al., An active murine transposon family pair: retrotransposition of "master" MusD copies and ETn trans-mobilization. Genome Res. Nov. 2004;14(11):2261-7. doi: 10.1101/gr.2924904. Epub Oct. 12, 2004.
Roth, J.R., Frameshift suppression. Cell. Jun. 1981;24(3):601-2. doi: 10.1016/0092-8674(81)90086-6.
Schwartz et al., A superactive insulin: [B10-aspartic acid]insulin(human). Proc Natl Acad Sci U S A. Sep. 1987;84(18):6408-11. doi: 10.1073/pnas.84.18.6408.
Sharma et al., CRISPR-Cas9: A Preclinical and Clinical Perspective for the Treatment of Human Diseases. Mol Ther. Feb. 3, 2021;29(2):571-586. doi: 10.1016/j.ymthe.2020.09.028. Epub Sep. 20, 2020.
Spencer et al., Deep mutational scanning of *S. pyogenes* Cas9 reveals important functional domains. Sci Rep. Dec. 4, 2017;7(1):16836. doi: 10.1038/s41598-017-17081-y.
Su et al., Role of the RAD51-SWI5-SFR1 Ensemble in homologous recombination. Nucleic Acids Res. Jul. 27, 2016;44(13):6242-51. doi: 10.1093/nar/gkw375. Epub Apr. 30, 2016.
Tabebordbar et al., Directed evolution of a family of AAV capsid variants enabling potent muscle-directed gene delivery across species. Cell. Sep. 16, 2021;184(19):4919-4938.e22. doi: 10.1016/j.cell.2021.08.028. Epub Sep. 9, 2021.
Torres et al., Differential expression of human tRNA genes drives the abundance of tRNA-derived fragments. Proc Natl Acad Sci U S A. Apr. 23, 2019;116(17):8451-8456. doi: 10.1073/pnas.1821120116. Epub Apr. 8, 2019.
Van Alstyne et al., Gain of toxic function by long-term AAV9-mediated SMN overexpression in the sensorimotor circuit. Nat Neurosci. Jul. 2021;24(7):930-940. doi: 10.1038/s41593-021-00827-3. Epub Apr. 1, 2021.
Wang et al., AAV-delivered suppressor tRNA overcomes a nonsense mutation in mice. Nature. Apr. 2022;604(7905):343-348. doi: 10.1038/s41586-022-04533-3. Epub Mar. 23, 2022.
Wilkinson et al., Cas9-AAV6 gene correction of beta-globin in autologous HSCs improves sickle cell disease erythropoiesis in mice. Nat Commun. Jan. 29, 2021;12(1):686. doi: 10.1038/s41467-021-20909-x.
Yamaguchi et al., Isolation and purification of blasticidin S deaminase from Aspergillus terreus. J Antibiotics. Jan. 1, 1975;28(1):7-14.
Yamaguchi et al., Substrate Binding by Blasticidin S Deaminase, an Aminohydrolase for Novel 4-Aminopyrimidine Nucleosides. Pesticide Biochem Physiol. Feb. 1986;25(1):54-62.
Yamazaki et al., Intein Mediated Ligation of Protein Fragments—Application to Segmental Isotope Labeling of NMR Samples. Biophysics. May 25, 1999:39(3):182-184.

(56) References Cited

OTHER PUBLICATIONS

Zhu et al., Guide RNAs with embedded barcodes boost CRISPR-pooled screens. Genome Biol. Jan. 24, 2019;20(1):20. doi: 10.1186/s13059-019-1628-0.

* cited by examiner

Base editor can be divided into AAV-sized halves that undergo splicing in cells to form active editor

| | | | | |
|---|---|---|---|---|
| FIGS. 12A-12D | CBE3.9max | C•G to T•A editing (%) | Indels (%) | Edit-to-indel ratio |
| | Heart | 15 ± 3.8 | 1.4 ± 1.6 | 10.59 |
| | Muscle | 4.4 ± 4.3 | 0.38 ± 0.4 | 11.41 |
| | Brain | 0.12 ± 0.057 | 0.014 ± 0.021 | 8.43 |
| | Liver | 21 ± 17 | 0.96 ± 0.61 | 22.07 |
| | Lung | 0.22 ± 0.13 | 0.014 ± 0.016 | 15.28 |
| | Kidney | 0.19 ± 0.072 | 0.022 ± 0.015 | 8.60 |
| | Spleen | 0.038 ± 0.021 | 0.0021 ± 0.00016 | 18.17 |
| | Testis | 0.14 ± 0.18 | 0.0062 ± 0.00015 | 21.85 |
| | Sperm | 0.016 ± 0.0092 | 0.0035 ± 0.003 | 4.61 |
| | ABEmax | A•T to G•C editing (%) | Indels (%) | Edit-to-indel ratio |
| | Heart | 20 ± 1.4 | 0.3 ± 0.26 | 66.79 |
| | Muscle | 9.2 ± 6.8 | 0.15 ± 0.2 | 61.91 |
| | Brain | 1.7 ± 1.6 | 0.019 ± 0.017 | 89.78 |
| | Liver | 39 ± 5.1 | 2.4 ± 0.55 | 16.29 |
| | Lung | 3.5 ± 1.4 | 0.051 ± 0.023 | 67.13 |
| | Kidney | 1 ± 0.34 | 0.011 ± 0.0079 | 94.50 |
| | Spleen | 0.13 ± 0.11 | 0.0069 ± 0.004 | 18.00 |
| | Testis | 0.86 ± 0.27 | 0.024 ± 0.022 | 35.35 |
| | Sperm | 0.057 ± 0.0092 | 0.0057 ± 0.002 | 9.91 |
| | Trans-splicing ABE | A•T to G•C editing (%) | Indels (%) | Edit-to-indel ratio |
| | Heart | 14 ± 2.2 | 0.086 ± 0.039 | 160.10 |
| | Muscle | 1.5 ± 0.58 | 0.0072 ± 0.0021 | 206.19 |
| | Brain | 0.024 ± 0.022 | 0.0092 ± 0.0014 | 2.65 |
| | Liver | 6.4 ± 0.48 | 0.031 ± 0.018 | 209.18 |
| | Lung | 0.063 ± 0.095 | 0.0078 ± 0.00065 | 8.04 |
| | Kidney | 0.16 ± 0.14 | 0.0059 ± 0.003 | 26.47 |
| | Spleen | 0.012 ± 0.01 | 0.0076 ± 0.00024 | 1.54 |
| FIGS. 13A-13F | CBE3.9max P0 Injections: cortex | C•G to T•A editing (%) | Indels (%) | Edit-to-indel ratio |
| | AAV8 GFP-positive | 65 ± 8.6 | 12 ± 2.9 | 5.28 |
| | AAV9 GFP-positive | 64 ± 3.8 | 6.8 ± 2 | 9.50 |
| | PHP.B GFP-positive | 65 ± 2.2 | 12 ± 0.53 | 5.40 |
| | PHP.eB GFP-positive | 70 ± 3.7 | 11 ± 2.5 | 6.56 |
| | AAV8 unsorted | 37 ± 2.7 | 7.6 ± 2.7 | 4.90 |
| | AAV9 unsorted | 32 ± 8.7 | 4.6 ± 2 | 7.05 |
| | PHP.B unsorted | 43 ± 1.6 | 6.5 ± 0.76 | 6.68 |
| | PHP.eB unsorted | 50 ± 9.3 | 7.9 ± 0.93 | 6.34 |
| | CBE3.9max P0 Injections: cerebellum | C•G to T•A editing (%) | Indels (%) | Edit-to-indel ratio |
| | AAV8 GFP-positive | 43 ± 3.1 | 3.2 ± 1.3 | 13.37 |
| | AAV9 GFP-positive | 36 ± 7.8 | 1.9 ± 0.82 | 18.40 |
| | PHP.B GFP-positive | 53 ± 2.3 | 3.1 ± 0.22 | 16.79 |

FIG. 22A

| | | | | |
|---|---|---|---|---|
| FIGS. 13A-13F | CBE3.9max P0 Injections: cortex | C•G to T•A editing (%) | Indels (%) | Edit-to-indel ratio |
| continued | PHP.eB GFP-positive | 44 ± 11 | 1.8 ± 0.13 | 23.77 |
| | AAV8 unsorted | 0.52 ± 0.52 | 0.0099 ± 0.004 | 52.67 |
| | AAV9 unsorted | 2.6 ± 1.6 | 0.41 ± 0.47 | 6.33 |
| | PHP.B unsorted | 1.7 ± 0.79 | 0.2 ± 0.14 | 8.26 |
| | PHP.eB unsorted | 1.6 ± 0.57 | 0.099 ± 0.16 | 16.30 |
| | ABEmax P0 Injections: cortex | A•T to G•C editing (%) | Indels (%) | Edit-to-indel ratio |
| | ABE A9 GFP-positive | 87 ± 4 | 2 ± 0.53 | 42.92 |
| | ABE A9 unsorted | 44 ± 9.1 | 0.9 ± 0.24 | 48.77 |
| | ABEmax P0 Injections: cerebellum | A•T to G•C editing (%) | Indels (%) | Edit-to-indel ratio |
| | ABE A9 GFP-positive | 64 ± 5.6 | 0.39 ± 0.3 | 163.27 |
| | ABE A9 unsorted | 1.3 ± 0.58 | 0.0072 ± 0.0029 | 183.88 |
| | CBE3.9max PHP.eB retro-orbital Injections | C•G to T•A editing (%) | Indels (%) | Edit-to-indel ratio |
| | Cortex GFP-positive | 75 ± 1.2 | 6.2 ± 2.6 | 12.03 |
| | Cortex unsorted | 59 ± 3 | 8 ± 3.1 | 7.35 |
| | Cerebellum GFP-positive | 70 ± 2.6 | 1.8 ± 0.57 | 38.32 |
| | Cerebellum unsorted | 36 ± 3.1 | 2.2 ± 0.43 | 15.84 |
| FIGS. 14A-14F | CBE3.9max PHP.B subretinal injections | C•G to T•A editing (%) | Indels (%) | Edit-to-indel ratio |
| | CBE unmarked rods | 19 ± 8.8 | 11 ± 5.7 | 1.67 |
| | CBE marked rods | 48 ± 5.9 | 34 ± 15 | 1.44 |
| | CBE marked non-rods | 43 ± 6.7 | 27 ± 13 | 1.61 |
| | CBE3.9max Anc80 subretinal injections | C•G to T•A editing (%) | Indels (%) | Edit-to-indel ratio |
| | CBE unmarked rods | 5.7 ± 1.2 | 1.4 ± 0.49 | 4.15 |
| | CBE marked rods | 38 ± 1.2 | 28 ± 8.9 | 1.34 |
| | CBE marked non-rods | 35 ± 9.3 | 25 ± 7.4 | 1.41 |
| | ABEmax Anc80 subretinal injections | A•T to G•C editing (%) | Indels (%) | Edit-to-indel ratio |
| | ABE transduced cells (RG + G) | 29 ± 23 | 1.6 ± 2 | 17.59 |
| | ABE unmarked (R) rods | 23 ± 17 | 1.9 ± 1.3 | 11.97 |
| | ABE unmarked non-rods | 8.8 ± 5.2 | 0.18 ± 0.26 | 48.22 |

FIG. 22B

| | | | | |
|---|---|---|---|---|
| FIGS. 15A-15H | CBE3.9max P0 Injections: $1x10^{11}$ vg | C•G to T•A editing (%) | Indels (%) | Edit-to-indel ratio |
| | Cortex GFP-positive | 82 ± 3.7 | 0.82 ± 0.15 | 100.27 |
| | Cortex unsorted | 48 ± 8.2 | 0.53 ± 0.36 | 90.43 |
| | Cerebellum GFP-positive | 42 ± 15 | 0.064 ± 0.059 | 663.78 |
| | Cerebellum unsorted | 0.35 ± 0.23 | 0.034 ± 0.0052 | 10.2 |
| | CBE3.9max P0 Injections: $4x10^{10}$ vg | C•G to T•A editing (%) | Indels (%) | Edit-to-indel ratio |
| | Cortex GFP-positive | 47 ± 22 | 0.33 ± 0.45 | 140.68 |
| | Cortex unsorted | 31 ± 16 | 0.27 ± 0.082 | 114.37 |
| | Cerebellum GFP-positive | 12 ± 8.4 | 0.021 ± 0.0024 | 552.9 |
| | Cerebellum unsorted | 0.4 ± 0.51 | 0.017 ± 0.0015 | 22.84 |
| FIGS. 18A-18C | saCBE3.9max RO Injections | TGG to STOP editing (%) | Indels (%) | Edit-to-indel ratio |
| | Villiger/Schwank $1x10^{12}$ vg | 19 ± 1.9 | 6.7 ± 0.94 | 2.79 |
| | Villiger/Schwank $1x10^{11}$ vg | 8.4 ± 3.2 | 3.2 ± 0.63 | 2.59 |
| | Levy/Liu AAV $1x10^{12}$ vg | 21± 0.72 | 8.8 ± 0.4 | 2.35 |
| | Levy/Liu AAV $1x10^{11}$ vg | 26 ± 6.2 | 7.2 ± 0.94 | 3.54 |
| FIGS. 20A-20B | CBE3.9max P0 $NPC1^{I1061T/+}$ Injections: P29 | Cells edited (%) | Indels (%) | Edit-to-indel ratio |
| | Cortex GFP-positive | 59 ± 5.5 | 0.48 ± 0.42 | 124.72 |
| | Cortex unsorted | 29 ± 5.7 | 0.12 ± 0.043 | 238.64 |
| | Cerebellum GFP-positive | 32 ± 5.8 | 0.11 ± 0.0071 | 292.47 |
| | Cerebellum unsorted | 5.3 ± 8.1 | 0.029 ± 0.003 | 179.19 |
| | CBE3.9max P0 $NPC1^{I1061T/+}$ Injections: P110 | Cells edited (%) | Indels (%) | Edit-to-indel ratio |
| | Cortex GFP-positive | 82 ± 7.2 | 0.34 ± 0.25 | 240.62 |
| | Cortex unsorted | 47 ± 6 | 0.27 ± 0.27 | 171.76 |
| | Cerebellum GFP-positive | 55 ± 11 | 0.17 ± 0.13 | 318.35 |
| | Cerebellum unsorted | 1.8 ± 4.1 | 0.054 ± 0.0065 | 33.21 |

FIG. 22C

Primers used to insert spaces into AAV vectors (SEQ ID NOs: 598-605)

| | |
|---|---|
| DNMT1-fwd | CACCGCGGGCTGGAGCTGTTCGCGC |
| DNMT1-rev | AAACGCGCGAACAGCTCCAGCCCGC |
| NPC1-fwd | CACCGCTAACAGCCAGTAACATCA |
| NPC1-rev | AAACTGATGTTACTGGCTGTTAGC |
| DNMT1_ABE-fwd | CACCGAACAGCTCTGAACGAGACCC |
| DNMT1_ABE-rev | AAACGGGTCTCGTTCAGAGCTGTTC |
| PCSK9-W8X-fwd | CACCGCCACCGCAGCCACGCAGAGCA |
| PCSK9-W8X-rev | AAACTGCTCTGCGTGGCTGCGGTGGC |

Primers used to amplify genomic DNA for HTS (SEQ ID NOs: 606-626)

| | |
|---|---|
| DNMT1_ABE_fwd | **ACACTCTTTCCCTACACGACGCTCTTCCGATCTNNNN**CCTTCGGGCATAGCATGGTC |
| DNMT1_ABE_rev | **TGGAGTTCAGACGTGTGCTCTTCCGATCT**TATATGCCTCGGCATCGGTCC |
| NPC1-fwd | **ACACTCTTTCCCTACACGACGCTCTTCCGATCTNNNN**GGGGACATGCTGCTTACGGTT |
| NPC1-rev | **TGGAGTTCAGACGTGTGCTGTTCCGATCT**TGGCCCGCTCACCTCAAATGC |
| DNMT1-fwd | **ACACTCTTTCCCTACACGACGCTCTTCCATCTNNNN**GCCGGGGTCTCGTTCAGAGCT |
| DNMT1-rev | **TGGAGTTCAGACGTGTGCTCTTCCGATCT**CTACCGCCTGCGGACATGGT |
| EMX1-fwd | **ACACTCTTTCCCTACACGACGCTCTTCCGATCTNNNN**CAGCTCAGCCTGAGTGTTGA |
| EMX1-rev | **TGGAGTTCAGACGTGTGCTCTTCCGATCT**CTCGTGGGTTTGTGGTTGC |
| FANCF-fwd | **ACACTCTTTCCCTACACGACGCTCTTCCGATCTNNNN**CATTGCAGAGAGGCGTATCA |
| FANCF-rev | **TGGAGTTCAGACGTGTGCTCTTCCGATCT**GGGGTCCCAGGTGCTGAC |
| HEK293_site2-fwd | **ACACTCTTTCCCTACACGACGCTCTTCCGATCTNNNN**CCAGCCCCATCTGTCAAACT |
| HEK293_site2-rev | **TGGAGTTCAGACGTGTGCTCTTCCGATCT**TGAATGGATTCCTTGGAAACAATGA |
| HEK293_site3-fwd | **ACACTCTTTCCCTACACGACGCTCTTCCGATCTNNNN**ATGTGGGCTGCCTAGAAAGG |
| HEK293_site3-rev | **TGGAGTTCAGACGTGTGCTCTTCCGATCT**CCCAGCCAAACTTGTCAACC |
| HEK293_site4-fwd | **ACACTCTTTCCCTACACGACGCTCTTCCGATCTNNNN**GAACCCAGGTAGCCAGAGAC |
| HEK293_site4-rev | **TGGAGTTCAGACGTGTGCTCTTCCGATCT**TCCTTTCAACCCGAACGGAG |
| RNF2-fwd | **ACACTCTTTCCCTACACGACGCTCTTCCGATCTNNNN**ACGTCTCATATGCCCCTTGG |
| RNF2-rev | **TGGAGTTCAGACGTGTGCTCTTCCGATCT**ACGTAGGAATTTTGGTGGGACA |
| PCSK9-W8X-fwd | **ACACTCTTTCCCTACACGACGCTCTTCCGATCTNNNN**GGCGTCCATGTCCTTCCCGA |
| PCSK9-W8X-rev | **TGGAGTTCAGACGTGTGCTCTTCCGATCT**ACATGTGCGGCCTCATCAGCCA |
| NPC1_OT1-TMC1-fwd | **ACACTCTTTCCCTACACGACGCTTCTTCCGATCTNNN**AGAACAATGGGGATGGGGAGGTT |

FIG. 25A

Primers used to amplify genomic DNA for HTS (SEQ ID NOs: 627-641)

| | |
|---|---|
| NPC1_OT1-TMC1-rev | **TGGAGTTCAGACGTGTGCTCTTCCGATCT**CTCAGTGGCCTCGTACTTCCT |
| NPC1_OT2-Telo2-fwd | **ACACTCTTTCCCTACACGACGCTCTTCCGATCTNNNN**GGCAGGGCTTCCAGTCCTCATT |
| NPC1_OT2-Telo2-rev | **TGGAGTTCAGACGTGTGCTCTTCCGATCT**GTGCTCATTCTGGGCTCTTTTTGGC |
| NPC1_OT3-Epas1-fwd | **ACACTCTTTCCCTACACGACGCTCTTCCGATCTNNNN**CCCGGCCCCACCTATACTCAAA |
| NPC1_OT3-Epas1-rev | **TGGAGTTCAGACGTGTGCTGTTCCGATCT**GCTTGCTGCGCTAGCCTTCAT |
| NPC1_OT4-Chr5-rev | **ACACTCTTTCCCTACACGACGCTCTTCCGATCTNNNN**CTACCCAGGGAGATTCATGC |
| NPC1_OT4-Chr5-rev | **TGGAGTTCAGACGTGTGCTCTTCCGATCT**TGGACTGAACCTCTGAACCTG |
| NPC1_OT5-Chr1-rev | **ACACTCTTTCCCTACACGACGCTCTTCCGATCTNNNN**CTGCACACTCTGTGGAGAACTGGT |
| NPC1_OT5-Chr1-rev | **TGGAGTTCAGACGTGTGCTCTTCCGATCT**AGTGTGTCCATGTGATTTGAATGCT |
| NPC1_OT6-Chr13-rev | **ACACTCTTTCCCTACACGACGCTCTTCCGATCTNNNN**GGCCAGCCTTCATCCTTGGC |
| NPC1_OT6-Chr13-rev | **TGGAGTTCAGACGTGTGCTCTTCCGATCT**TGCGTGGCTAGGTGGGCTTT |
| NPC1_OT7-Chr13 #2-rev | **ACACTCTTTCCCTACACGACGCTCTTCCGATCTNNNN**TCTGCAACCTGTGGGCTCAAGA |
| NPC1_OT7-Chr13 #2-rev | **TGGAGTTCAGACGTGTGCTCTTCCGATCT**AGTCAGATCTCTCCAGGGGTCAT |
| NPC1_OT8-Chr3-rev | **ACACTCTTTCCCTACACGACGCTCTTCCGATCTNNNN**AGGTTTGCTGCGGTATTTTCA |
| NPC1_OT8-Chr3-rev | **TGGAGTTCAGACGTGTGCTCTTCCGATCT**TGTGTAGTGAAGAAATGGAAACCT |

FIG. 25B

AAV ITR
Cbh promoter
Bipartite NLS
rAPOBEC1 (CBEmax)
tadA (ABEmax)
Linkers
Cas9 (N- or C-terminal specified in construct title)
Npu N-terminal fragment
Npu C-terminal fragment
UGI
W3
bGH
U6-sgRNA
sgRNA spacer
RFP dropout cassette (ABEmax)

CBE3.9max v3 AVV-terminal (SEQ ID NO: 642)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTTGTAGTTAATGATTAACCCGCCATGCTACTTATCTACGTAGCCATGCTCTAGGAAGATC
GGAATTCGCCCTTAAGAAGGTCGGGCAGGAAGAGGGCCTATTTCCCATGATTCCTTCATATTTGC
ATATACGATACAAGGCTGTTAGAGAGATAATTAGAATTAATTTGACTGTAAACACAAAGATATTAG
TACAAAATACGTGACGTAGAAAGTAATAATTTCTTGGGTAGTTTGCAGTTTTAAAATTATGTTTTAA
AATGGACTATCATATGCTTACCGTAACTTGAAAGTATTTCGATTTCTTGGCTTTATATATCTTGTGG
AAAGGACGAAACACCCGAGACGATTAATGCGTCTCGGTTTTAGAGCTAGAAATAGCAAGTTAAAA
TAAGGCTAGTCCGTTATCAACTTGAAAAAGTGGCACCGAGTCGGTGCTTTTTTTGCTAGCGGTAC
CCGTTACATAACTTACGGTAAATGGCCCGCCTGGCTGACCGCCCAACGACCCCCGCCCATTGAC
GTCAATAGTAACGCCAATAGGGACTTTCCATTGACGTCAATGGGTGGAGTATTTACGGTAAACTG
CCCACTTGGCAGTACATCAAGTGTATCATATGCCAAGTACGCCCCCTATTGACGTCAATGACGGT
AAATGGCCCGCCTGGCATTGTGCCCAGTACATGACCTTATGGGACTTTCCTACTTGGCAGTACAT
CTACGTATTAGTCATCGCTATTACCATGGTCGAGGTGAGCCCCACGTTCTGCTTCACTCTCCCCA
TCTCCCCCCCCTCCCCACCCCCAATTTTGTATTTATTTATTTTTTAATTATTTTGTGCAGCGATGGG
GGCGGGGGGGGGGGGGGCGCGCGCCAGGCGGGGCGGGGCGGGGCGAGGGGCGGGGCG
GGGCGAGGCGGAGAGGTGCGGCGGCAGCCAATCAGAGCGGCGCGCTCCGAAAGTTTCCTTTTA
TGGCGAGGCGGCGGCGGCGGCGGCCCTATAAAAAGCGAAGCGCGCGGCGGGCGGGAGTCGC
TGCGACGCTGCCTTCGCCCCGTGCCCCGCTCCGCCGCCGCCTCGCGCCGCCCGCCCCGGCTC
TGACTGACCGCGTTACTCCCACAGGTGAGCGGGCGGGACGGCCCTTCTCCTCCGGGCTGTAAT
TAGCTGAGCAAGAGGTAAGGGTTTAAGGGATGGTTGGTTGGTGGGGTATTAATGTTTAATTACCT

FIG. 26A (SEQ ID NO: 642 continued)

GGAGCACCTGCCTGAAATCACTTTTTTTCAGGTTGGACCGGTGCCACCATGAAGAGGACTGCCG
ATGGATCAGAGTTTGAATCTCCCAAGAAGAAGAGGAAAGTAAGCTCAGAGACTGGCCCAGTGGC
TGTGGACCCCACATTAAGACGGCGGATCGAGCCCCATGAGTTTGAGGTATTCTTCGATCCGAGA
GAGCTCCGCAAGGAGACCTGCCTGCTTTACGAAATTAATTGGGGGGGCCGGCACTCCATTTGGC
GACATACATCACAGAACACTAACAAGCACGTCGAAGTCAACTTCATCGAGAAGTTCACGACAGAA
AGATATTTCTGTCCGAACACAAGGTGCAGCATTACCTGGTTTCTCAGCTGGAGCCCATGCGGCG
AATGTAGTAGGGCCATCACTGAATTCCTGTCAAGGTATCCCCACGTCACTCTGTTTATTTACATCG
CAAGGCTGTACCACCACGCTGACCCCCGCAATCGACAAGGCCTGCGGCATTTGATCTCTTCAGG
TGTGACTATCCAAATTATGACTGAGCAGGAGTCAGGATACTGCTGGAGAAACTTTGTGAATTATA
GCCCGAGTAATGAAGCCCACTGGCCTAGGTATCCCCATCTGTGGGTACGACTGTACGTTCTTGA
ACTGTACTGCATCATACTGGGCCTGCCTCCTTGTCTCAACATTCTGAGAAGGAAGCAGCCACAG
CTGACATTCTTTACCATCGCTCTTCAGTCTTGTCATTACCAGCGACTGCCCCCACACATTCTCTG
GGCCACCGGGTTGAAATCTGGTGGTTCTTCTGGTGGTTCTAGCGGCAGCGAGACTCCCGGGAC
CTCAGAGTCCGCCACACCCGAAAGTTCTGGTGGTTCTTCTGGTGGTTCTGATAAAAAGTATTCTA
TTGGTTTAGCCATCGGCACTAATTCCGTTGGATGGGCTGTCATAACCGATGAATACAAAGTACCT
TCAAAGAAATTTAAGGTGTTGGGAACACAGACCGTCATTCGATTAAAAAGAATCTTATCGGTGC
CCTCCTATTCGATAGTGGCGAAACGGCAGAGGCGACTCGCCTGAAACGAACCGCTCGGAGAAG
GTATACACGTCGCAAGAACCGAATATGTTACTTACAAGAAATTTTTAGCAATGAGATGGCCAAAGT
TGACGATTCTTTCTTTCACCGTTTGGAAGAGTCCTTCCTTGTCGAAGAGGACAAGAAACATGAAC
GGCACCCCATCTTTGGAAACATAGTAGATGAGGTGGCATATCATGAAAAGTACCCAACGATTTAT
CACCTCAGAAAAAAGCTAGTTGACTCAACTGATAAAGCGGACCTGAGGTTAATCTACTTGGCTCT
TGCCCATATGATAAAGTTCCGTGGGCACTTTCTCATTGAGGGTGATCTAAATCCGGACAACTCGG
ATGTCGACAAACTGTTCATCCAGTTAGTACAAACCTATAATCAGTTGTTTGAAGAGAACCCTATAA
ATGCAAGTGGCGTGGATGCGAAGGCTATTCTTAGCGCCCGCCTCTCTAAATCCCGACGGCTAGA
AAACCTGATCGCACAATTACCCGGAGAGAAGAAAAATGGGTTGTTCGGTAACCTTATAGCGCTCT
CACTAGGCCTGACACCAAATTTTAAGTCGAACTTCGACTTAGCTGAAGATGCCAAATTGCAGCTT
AGTAAGGACACGTACGATGACGATCTCGACAATCTACTGGCACAAATTGGAGATCAGTATGCGG
ACTTATTTTTGGCTGCCAAAAACCTTAGCGATGCAATCCTCCTATCTGACATACTGAGAGTTAATA
CTGAGATTACCAAGGCGCCGTTATCCGCTTCAATGATCAAAAGGTACGATGAACATCACCAAGAC
TTGACACTTCTCAAGGCCCTAGTCCGTCAGCAACTGCCTGAGAAATATAAGGAAATATTCTTTGAT
CAGTCGAAAAACGGGTACGCAGGTTATATTGACGGCGGAGCGAGTCAAGAGGAATTCTACAAGT
TTATCAAACCCATATTAGAGAAGATGGATGGGACGGAAGAGTTGCTTGTAAAACTCAATCGCGAA
GATCTACTGCGAAAGCAGCGGACTTTCGACAACGGTAGCATTCCACATCAAATCCACTTAGGCG
AATTGCATGCTATACTTAGAAGGCAGGAGGATTTTTATCCGTTCCTCAAAGACAATCGTGAAAAG
ATTGAGAAAATCCTAACCTTTCGCATACCTTACTATGTGGGACCCCTGGCCCGAGGGAACTCTCG
GTTCGCATGGATGACAAGAAAGTCCGAAGAAACGATTACTCCATGGAATTTTGAGGAAGTTGTCG
ATAAAGGTGCGTCAGCTCAATCGTTCATCGAGAGGATGACCAACTTTGACAAGAATTTACCGAAC
GAAAAGTATTGCCTAAGCACAGTTTACTTTACGAGTATTTCACAGTGTACAATGAACTCACGAAA
GTTAAGTATGTCACTGAGGGCATGCGTAAACCCGCCTTTCTAAGCGGAGAACAGAAGAAAGCAA
TAGTAGATCTGTTATTCAAGACCAACCGCAAAGTGACAGTTAAGCAATTGAAAGAGGACTACTTTA
AGAAAATTGAATGCCTGTCATACGAAACCGAGATACTGACAGTAGAATATGGCCTTCTGCCAATC
GGGAAGATTGTGGAGAAACGGATAGAATGCACAGTTTACTCTGTCGATAACAATGGTAACATTTA
TACTCAGCCAGTTGCCCAGTGGCACGACCGGGGAGAGCAGGAAGTATTCGAATACTGTCTGGA
GGATGGAAGTCTCATTAGGGCCACTAAGGACCACAAATTTATGACAGTCGATGGCCAGATGCTG
CCTATAGACGAAATCTTTGAGCGAGAGTTGGACCTCATGCGAGTTGACAACCTTCCTAATTCTGG
TGGTTCTAAAAGAACCGCCGACGGCAGCGAATTCGAGCCCAAGAAGAAGAGGAAAGTCTAAGAT
CTGATAATCAACCTCTGGATTACAAAATTTGTGAAAGATTGACTGGTATTCTTAACTATGTTGCTC
CTTTTACGCTATGTGGATACGCTGCTTTAATGCCTTTGTATCATGCTATTGCTTCCCGTATGGCTT
TCATTTTCTCCTCCTTGTATAAATCCTGGTTAGTTCTTGCCACGGCGGAACTCATCGCCGCCTGC

FIG. 26B (SEQ ID NO: 642 continued)

CTTGCCCGCTGCTGGACAGGGGCTCGGCTGTTGGGCACTGACAATTCCGTGGTGCGACTGTGC
CTTCTAGTTGCCAGCCATCTGTTGTTTGCCCCTCCCCCGTGCCTTCCTTGACCCTGGAAGGTGCC
ACTCCCACTGTCCTTTCCTAATAAAATGAGGAAATTGCATCGCATTGTCTGAGTAGGTGTCATTCT
ATTCTGGGGGGTGGGGTGGGGCAGGACAGCAAGGGGGAGGATTGGGAAGACAATAGCAGGCA
TGCTGGGGATGCGGTGGGCTCTATGGCTCGAGTTAAGGGCGAATTCCCGATAAGGATCTTCCTA
GAGCATGGCTACGTAGATAAGTAGCATGGCGGGTTAATCATTAACTACAAGGAACCCCTAGTGAT
GGAGTTGGCCACTCCCTCTCTGCGCGCTCGCTCGCTCACTGAGGCCGGGCGACCAAAGGTCGC
CCGACGCCCGGGCTTTGCCCGGGCGGCCTCAGTGAGCGAGCGAGCGCGCAG

CBE3.9max v3 AAV C-terminal (SEQ ID NO: 643)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTTGTAGTTAATGATTAACCCGCCATGCTACTTATCTACGTAGCCATGCTCTAGGAAGATC
GGAATTCGCCCTTAAGAAGGTCGGGCAGGAAGAGGGCCTATTTCCCATGATTCCTTCATATTTGC
ATATACGATACAAGGCTGTTAGAGAGATAATTAGAATTAATTTGACTGTAAACACAAAGATATTAG
TACAAAATACGTGACGTAGAAAGTAATAATTTCTTGGGTAGTTTGCAGTTTTAAAATTATGTTTTAA
AATGGACTATCATATGCTTACCGTAACTTGAAAGTATTTCGATTTCTTGGCTTTATATATCTTGTGG
AAAGGACGAAACACCGAGACGATTAATGCGTCTCGGTTTTAGAGCTAGAAATAGCAAGTTAAAA
TAAGGCTAGTCCGTTATCAACTTGAAAAAGTGGCACCGAGTCGGTGCTTTTTTTGCTAGCGGTAC
CCGTTACATAACTTACGGTAAATGGCCCGCCTGGCTGACCGCCCAACGACCCCCGCCCATTGAC
GTCAATAGTAACGCCAATAGGGACTTTCCATTGACGTCAATGGGTGGAGTATTTACGGTAAACTG
CCCACTTGGCAGTACATCAAGTGTATCATATGCCAAGTACGCCCCCTATTGACGTCAATGACGGT
AAATGGCCCGCCTGGCATTGTGCCCAGTACATGACCTTATGGGACTTTCCTACTTGGCAGTACAT
CTACGTATTAGTCATCGCTATTACCATGGTCGAGGTGAGCCCCACGTTCTGCTTCACTCTCCCCA
TCTCCCCCCCCTCCCCACCCCCAATTTTGTATTTATTTATTTTTTAATTATTTTGTGCAGCGATGGG
GGCGGGGGGGGGGGGGGGGCGCGCGCCAGGCGGGGCGGGGCGGGGCGAGGGGCGGGGCGG
GGCGAGGCGGAGAGGTGCGGCGGCAGCCAATCAGAGCGGCGCGCTCCGAAAGTTTCCTTTTA
TGGCGAGGCGGCGGCGGCGGCGGCCCTATAAAAAGCGAAGCGCGCGGCGGGCGGGAGTCGC
TGCGACGCTGCCTTCGCCCCGTGCCCCGCTCCGCCGCCGCCTCGCGCCGCCCGCCCCGGCTC
TGACTGACCGCGTTACTCCCACAGGTGAGCGGGCGGGACGGCCCTTCTCCTCCGGGCTGTAAT
TAGCTGAGCAAGAGGTAAGGGTTTAAGGGATGGTTGGTTGGTGGGGTATTAATGTTTAATTACCT
GGAGCACCTGCCTGAAATCACTTTTTTTCAGGTTGGACCGGTGCCACCATGAAGAGGACTGCCG
ATGGATCAGAGTTTGAATCTCCCAAGAAGAAGAGGAAAGTAATCAAGATAGCTACAAGGAAGTAT
CTTGGCAAACAAAACGTTTATGATATTGGAGTCGAAAGAGATCACAACTTTGCTCTGAAGAACGG
ATTCATAGCTTCTAATTGCTTCGATTCTGTCGAGATCTCCGGGGTAGAAGATCGATTTAATGCGTC
ACTTGGTACGTATCATGACCTCCTAAAGATAATTAAAGATAAGGACTTCCTGGATAACGAAGAGA
ATGAAGATATCTTAGAAGATATAGTGTTGACTCTTACCCTCTTTGAAGATCGGGAAATGATTGAGG
AAAGACTAAAAACATACGCTCACCTGTTCGACGATAAGGTTATGAAACAGTTAAAGAGGCGTCGC
TATACGGGCTGGGGACGATTGTCGCGGAAACTTATCAACGGGATAAGAGACAAGCAAAGTGGTA
AAACTATTCTCGATTTTCTAAAGAGCGACGGCTTCGCCAATAGGAACTTTATGCAGCTGATCCAT
GATGACTCTTTAACCTTCAAAGAGGATATACAAAAGGCACAGGTTTCCGGACAAGGGGACTCATT
GCACGAACATATTGCGAATCTTGCTGGTTCGCCAGCCATCAAAAAGGGCATACTCCAGACAGTC
AAAGTAGTGGATGAGCTAGTTAAGGTCATGGGACGTCACAAACCGGAAAACATTGTAATCGAGAT
GGCACGCGAAAATCAAACGACTCAGAAGGGGCAAAAAAACAGTCGAGAGCGGATGAAGAGAATA
GAAGAGGGTATTAAAGAACTGGGCAGCCAGATCTTAAAGGAGCATCCTGTGGAAAATACCCAATT
GCAGAACGAGAAACTTTACCTCTATTACCTACAAAATGGAAGGGACATGTATGTTGATCAGGAAC
TGGACATAAACCGTTTATCTGATTACGACGTCGATCACATTGTACCCCAATCCTTTTTGAAGGACG
ATTCAATCGACAATAAAGTGCTTACACGCTCGGATAAGAACCGAGGGAAAAGTGACAATGTTCCA
AGCGAGGAAGTCGTAAAGAAAATGAAGAACTATTGGCGGCAGCTCCTAAATGCGAAACTGATAA

FIG. 26C (SEQ ID NO: 643 continued)

CGCAAAGAAAGTTCGATAACTTAACTAAAGCTGAGAGGGGTGGCTTGTCTGAACTTGACAAGGC
CGGATTTATTAAACGTCAGCTCGTGGAAACCCGCCAAATCACAAAGCATGTTGCACAGATACTAG
ATTCCCGAATGAATACGAAATACGACGAGAACGATAAGCTGATTCGGGAAGTCAAAGTAATCACT
TTAAAGTCAAAATTGGTGTCGGACTTCAGAAAGGATTTTCAATTCTATAAAGTTAGGGAGATAAAT
AACTACCACCATGCGCACGACGCTTATCTTAATGCCGTCGTAGGGACCGCACTCATTAAGAAATA
CCCGAAGCTAGAAAGTGAGTTTGTGTATGGTGATTACAAAGTTTATGACGTCCGTAAGATGATCG
CGAAAAGCGAACAGGAGATAGGCAAGGCTACAGCCAAATACTTCTTTTATTCTAACATTATGAATT
TCTTTAAGACGGAAATCACTCTGGCAAACGGAGAGATACGCAAACGACCTTTAATTGAAACCAAT
GGGGAGACAGGTGAAATCGTATGGGATAAGGGCCGGGACTTCGCGACGGTGAGAAAAGTTTTG
TCCATGCCCCAAGTCAACATAGTAAAGAAAACTGAGGTGCAGACCGGAGGGTTTTCAAAGGAAT
CGATTCTTCCAAAAAGGAATAGTGATAAGCTCATCGCTCGTAAAAAGGACTGGGACCCGAAAAAG
TACGGTGGCTTCGATAGCCCTACAGTTGCCTATTCTGTCCTAGTAGTGGCAAAAGTTGAGAAGG
GAAAATCCAAGAAACTGAAGTCAGTCAAAGAATTATTGGGGATAACGATTATGGAGCGCTCGTCT
TTTGAAAAGAACCCCATCGACTTCCTTGAGGCGAAAGGTTACAAGGAAGTAAAAAAGGATCTCAT
AATTAAACTACCAAAGTATAGTCTGTTTGAGTTAGAAAATGGCCGAAAACGGATGTTGGCTAGCG
CCGGAGAGCTTCAAAAGGGGAACGAACTCGCACTACCGTCTAAATACGTGAATTTCCTGTATTTA
GCGTCCCATTACGAGAAGTTGAAAGGTTCACCTGAAGATAACGAACAGAAGCAACTTTTTGTTGA
GCAGCACAAACATTATCTCGACGAAATCATAGAGCAAATTTCGGAATTCAGTAAGAGAGTCATCC
TAGCTGATGCCAATCTGGACAAAGTATTAAGCGCATACAACAAGCACAGGGATAAACCCATACGT
GAGCAGGCGGAAAATATTATCCATTTGTTTACTCTTACCAACCTCGGCGCTCCAGCCGCATTCAA
GTATTTTGACACAACGATAGATCGCAAACGATACACTTCTACCAAGGAGGTGCTAGACGCGACAC
TGATTCACCAATCCATCACGGGATTATATGAAACTCGGATAGATTTGTCACAGCTTGGGGGTGAC
TCTGGTGGTTCTGGAGGATCTGGTGGTTCTACTAATCTGTCAGATATTATTGAAAAGGAGACCGG
TAAGCAACTGGTTATCCAGGAATCCATCCTCATGCTCCCAGAGGAGGTGGAAGAAGTCATTGGG
AACAAGCCGGAAAGCGATATACTCGTGCACACCGCCTACGACGAGAGCACCGACGAGAATGTCA
TGCTTCTGACTAGCGACGCCCCTGAATACAAGCCTTGGGCTCTGGTCATACAGGATAGCAACGG
TGAGAACAAGATTAAGATGCTCTCTGGTGGTTCTAAAAGAACCGCCGACGGCAGCGAATTCGAG
CCCAAGAAGAAGAGGAAAGTCTAAGATCTGATAATCAACCTCTGGATTACAAAATTTGTGAAAGA
TTGACTGGTATTCTTAACTATGTTGCTCCTTTTACGCTATGTGGATACGCTGCTTTAATGCCTTTGT
ATCATGCTATTGCTTCCCGTATGGCTTTCATTTTCTCCTCCTTGTATAAATCCTGGTTAGTTCTTGC
CACGGCGGAACTCATCGCCGCCTGCCTTGCCCGCTGCTGGACAGGGGCTCGGCTGTTGGGCAC
TGACAATTCCGTGGTGCGACTGTGCCTTCTAGTTGCCAGCCATCTGTTGTTTGCCCCTCCCCCGT
GCCTTCCTTGACCCTGGAAGGTGCCACTCCCACTGTCCTTTCCTAATAAAATGAGGAAATTGCAT
CGCATTGTCTGAGTAGGTGTCATTCTATTCTGGGGGGTGGGGTGGGGCAGGACAGCAAGGGGG
AGGATTGGGAAGACAATAGCAGGCATGCTGGGGATGCGGTGGGCTCTATGGCTCGAGTTAAGG
GCGAATTCCCGATAAGGATCTTCCTAGAGCATGGCTACGTAGATAAGTAGCATGGCGGTTAAT
CATTAACTACAAGGAACCCCTAGTGATGGAGTTGGCCACTCCCTCTCTGCGCGCTCGCTCGCTC
ACTGAGGCCGGGCGACCAAAGGTCGCCCGACGCCCGGGCTTTGCCCGGGCGGCCTCAGTGAG
CGAGCGAGCGCGCAG

CBE3.9max v4 AAV N-terminal (SEQ ID NO: 644)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGACTCGAGAAGGTCGGGCAGGAAGAGGGCCTATTTCCCATGATTCCTT
CATATTTGCATATACGATACAAGGCTGTTAGAGAGATAATTAGAATTAATTTGACTGTAAACACAA
AGATATTAGTACAAAATACGTGACGTAGAAAGTAATAATTTCTTGGGTAGTTTGCAGTTTTAAAATT
ATGTTTTAAAATGGACTATCATATGCTTACCGTAACTTGAAAGTATTTCGATTTCTTGGCTTTATAT
ATCTTGTGGAAAGGACGAAACACCCGAGACGATTAATGCGTCTCGGTTTTAGAGCTAGAAATAGC
AAGTTAAAATAAGGCTAGTCCGTTATCAACTTGAAAAAGTGGCACCGAGTCGGTGCTTTTTTGCT

FIG. 26D (SEQ ID NO: 644 continued)

AGCGGTACCCCTTACATAACTTACGGTAAATGGCCCGCCTGGCTGACCGCCCAACGACCCCCG
CCCATTGACGTCAATAGTAACGCCAATAGGGACTTTCCATTGACGTCAATGGGTGGAGTATTTAC
GGTAAACTGCCCACTTGGCAGTACATCAAGTGTATCATATGCCAAGTACGCCCCCTATTGACGTC
AATGACGGTAAATGGCCCGCCTGGCATTGTGCCCAGTACATGACCTTATGGGACTTTCCTACTTG
GCAGTACATCTACGTATTAGTCATCGCTATTACCATGGTCGAGGTGAGCCCCACGTTCTGCTTCA
CTCTCCCCATCTCCCCCCCCTCCCCACCCCCAATTTTGTATTTATTTATTTTTTAATTATTTTGTGC
AGCGATGGGGGCGGGGGGGGGGGGGGGGCGCGCGCCAGGCGGGGCGGGGCGGGGCGAGG
GGCGGGGCGGGGCGAGGCGGAGAGGTGCGGCGGCAGCCAATCAGAGCGGCGCGCTCCGAAA
GTTTCCTTTTATGGCGAGGCGGCGGCGGCGGCGGCCCTATAAAAAGCGAAGCGCGCGGCGGG
CGGGAGTCGCTGCGACGCTGCCTTCGCCCCGTGCCCCGCTCCGCCGCCGCCTCGCGCCGCCC
GCCCCGGCTCTGACTGACCGCGTTACTCCCACAGGTGAGCGGGCGGGACGGCCCTTCTCCTCC
GGGCTGTAATTAGCTGAGCAAGAGGTAAGGGTTTAAGGGATGGTTGGTTGGTGGGGTATTAATG
TTTAATTACCTGGAGCACCTGCCTGAAATCACTTTTTTTCAGGTTGGACCGGTGCCACCATGTCC
TCAGAGACTGGGCCTGTCGCCGTCGATCCAACCCTGCGCCGCCGGATTGAACCTCACGAGTTT
GAAGTGTTCTTTGACCCCCGGGAGCTGAGAAAGGAGACATGCCTGCTGTACGAGATCAACTGGG
GAGGCAGGCACTCCATCTGGAGGCACACCTCTCAGAACACAAATAAGCACGTGGAGGTGAACTT
CATCGAGAAGTTTACCACAGAGCGGTACTTCTGCCCCAATACCAGATGTAGCATCACATGGTTTC
TGAGCTGGTCCCCTTGCGGAGAGTGTAGCAGGGCCATCACCGAGTTCCTGTCCAGATATCCACA
CGTGACACTGTTTATCTACATCGCCAGGCTGTATCACCACGCAGACCCAAGGAATAGGCAGGGC
CTGCGCGATCTGATCAGCTCCGGCGTGACCATCCAGATCATGACAGAGCAGGAGTCCGGCTACT
GCTGGCGGAACTTCGTGAATTATTCTCCTAGCAACGAGGCCCACTGGCCTAGGTACCCACACCT
GTGGGTGCGCCTGTACGTGCTGGAGCTGTATTGCATCATCCTGGGCCTGCCCCCTTGTCTGAAT
ATCCTGCGGAGAAAGCAGCCCCAGCTGACCTTCTTTACAATCGCCCTGCAGTCTTGTCACTATCA
GAGGCTGCCACCCCACATCCTGTGGGCCACAGGCCTGAAGTCTGGAGGATCTAGCGGAGGATC
CTCTGGCAGCGAGACACCAGGAACAAGCGAGTCAGCAACACCAGAGAGCAGTGGCGGCAGCAG
CGGCGGCAGCGACAAGAAGTACAGCATCGGCCTGGCCATCGGCACCAACTCTGTGGGCTGGGC
CGTGATCACCGACGAGTACAAGGTGCCCAGCAAGAAATTCAAGGTGCTGGGCAACACCGACCG
GCACAGCATCAAGAAGAACCTGATCGGAGCCCTGCTGTTCGACAGCGGCGAAACAGCCGAGGC
CACCCGGCTGAAGAGAACCGCCAGAAGAAGATACACCAGACGGAAGAACCGGATCTGCTATCT
GCAAGAGATCTTCAGCAACGAGATGGCCAAGGTGGACGACAGCTTCTTCCACAGACTGGAAGAG
TCCTTCCTGGTGGAAGAGGATAAGAAGCACGAGCGGCACCCCATCTTCGGCAACATCGTGGAC
GAGGTGGCCTACCACGAGAAGTACCCCACCATCTACCACCTGAGAAAGAAACTGGTGGACAGCA
CCGACAAGGCCGACCTGCGGCTGATCTATCTGGCCCTGGCCCACATGATCAAGTTCCGGGGCC
ACTTCCTGATCGAGGGCGACCTGAACCCCGACAACAGCGACGTGGACAAGCTGTTCATCCAGCT
GGTGCAGACCTACAACCAGCTGTTCGAGGAAAACCCCATCAACGCCAGCGGCGTGGACGCCAA
GGCCATCCTGTCTGCCAGACTGAGCAAGAGCAGACGGCTGGAAAATCTGATCGCCCAGCTGCC
CGGCGAGAAGAAGAATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCAAGGACACCTACGAC
GACGACCTGGACAACCTGCTGGCCCAGATCGGCGACCAGTACGCCGACCTGTTTCTGGCCGCC
AAGAACCTGTCCGACGCCATCCTGCTGAGCGACATCCTGAGAGTGAACACCGAGATCACCAAGG
CCCCCCTGAGCGCCTCTATGATCAAGAGATACGACGAGCACCACCAGGACCTGACCCTGCTGAA
AGCTCTCGTGCGGCAGCAGCTGCCTGAGAAGTACAAAGAGATTTTCTTCGACCAGAGCAAGAAC
GGCTACGCCGGCTACATTGACGGCGGAGCCAGCCAGGAAGAGTTCTACAAGTTCATCAAGCCC
ATCCTGGAAAAGATGGACGGCACCGAGGAACTGCTCGTGAAGCTGAACAGAGAGGACCTGCTG
CGGAAGCAGCGGACCTTCGACAACGGCAGCATCCCCCACCAGATCCACCTGGGAGAGCTGCAC
GCCATTCTGCGGCGGCAGGAAGATTTTTACCCATTCCTGAAGGACAACCGGGAAAAGATCGAGA
AGATCCTGACCTTCCGCATCCCCTACTACGTGGGCCCTCTGGCCAGGGGAAACAGCAGATTCGC
CTGGATGACCAGAAAGAGCGAGGAAACCATCACCCCCTGGAACTTCGAGGAAGTGGTGGACAA
GGGCGCTTCCGCCCAGAGCTTCATCGAGCGGATGACCAACTTCGATAAGAACCTGCCCAACGA

FIG. 26E (SEQ ID NO: 644 continued)

GAAGGTGCTGCCCAAGCACAGCCTGCTGTACGAGTACTTCACCGTGTATAACGAGCTGACCAAA
GTGAAATACGTGACCGAGGGAATGAGAAAGCCCGCCTTCCTGAGCGGCGAGCAGAAAAAGGCC
ATCGTGGACCTGCTGTTCAAGACCAACCGGAAAGTGACCGTGAAGCAGCTGAAAGAGGACTACT
TCAAGAAAATCGAGTGCCTGTCATACGAAACCGAGATACTGACAGTAGAATATGGCCTTCTGCCA
ATCGGGAAGATTGTGGAGAAACGGATAGAATGCACAGTTTACTCTGTCGATAACAATGGTAACAT
TTATACTCAGCCAGTTGCCCAGTGGCACGACCGGGGAGAGCAGGAAGTATTCGAATACTGTCTG
GAGGATGGAAGTCTCATTAGGGCCACTAAGGACCACAAATTTATGACAGTCGATGGCCAGATGC
TGCCTATAGACGAAATCTTTGAGCGAGAGTTGGACCTCATGCGAGTTGACAACCTTCCTAATTCT
GGTGGTTCTAAAAGAACCGCCGACGGCAGCGAATTCGAGCCCAAGAAGAAGAGGAAAGTCTAA
GATCTGATAATCAACCTCTGGATTACAAAATTTGTGAAAGATTGACTGGTATTCTTAACTATGTTG
CTCCTTTTACGCTATGTGGATACGCTGCTTTAATGCCTTTGTATCATGCTATTGCTTCCCGTATGG
CTTTCATTTTCTCCTCCTTGTATAAATCCTGGTTAGTTCTTGCCACGGCGGAACTCATCGCCGCCT
GCCTTGCCCGCTGCTGGACAGGGGCTCGGCTGTTGGGCACTGACAATTCCGTGGTGCGACTGT
GCCTTCTAGTTGCCAGCCATCTGTTGTTTGCCCCTCCCCCGTGCCTTCCTTGACCCTGGAAGGT
GCCACTCCCACTGTCCTTTCCTAATAAAATGAGGAAATTGCATCGCATTGTCTGAGTAGGTGTCA
TTCTATTCTGGGGGGTGGGGTGGGGCAGGACAGCAAGGGGGAGGATTGGGAAGACAATAGCAG
GCATGCTGGGGATGCGGTGGGCTCTATGGCGGCCGCAGGAACCCCTAGTGATGGAGTTGGC
CACTCCCTCTCTGCGCGCTCGCTCGCTCACTGAGGCCGGGCGACCAAAGGTCGCCCGACGCCC
GGGCTTTGCCCGGGCGGCCTCAGTGAGCGAGCGAGCGCGCAG

CBE3.9max v4 AAV C-terminal (SEQ ID NO: 645)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGACTCGAGAAGGTCGGGCAGGAAGAGGGCCTATTTCCCATGATTCCTT
CATATTTGCATATACGATACAAGGCTGTTAGAGAGATAATTAGAATTAATTTGACTGTAAACACAA
AGATATTAGTACAAAATACGTGACGTAGAAAGTAATAATTTCTTGGGTAGTTTGCAGTTTTAAAATT
ATGTTTTAAAATGGACTATCATATGCTTACCGTAACTTGAAAGTATTTCGATTTCTTGGCTTTATAT
ATCTTGTGGAAAGGACGAAACACCCGAGACGATTAATGCGTCTCGGTTTTAGAGCTAGAAATAGC
AAGTTAAAATAAGGCTAGTCCGTTATCAACTTGAAAAAGTGGCACCGAGTCGGTGCTTTTTTTGCT
AGCGGTACCCGTTACATAACTTACGGTAAATGGCCCGCCTGGCTGACCGCCCAACGACCCCCG
CCCATTGACGTCAATAGTAACGCCAATAGGGACTTTCCATTGACGTCAATGGGTGGAGTATTTAC
GGTAAACTGCCCACTTGGCAGTACATCAAGTGTATCATATGCCAAGTACGCCCCCTATTGACGTC
AATGACGGTAAATGGCCCGCCTGGCATTGTGCCCAGTACATGACCTTATGGGACTTTCCTACTTG
GCAGTACATCTACGTATTAGTCATCGCTATTACCATGGTCGAGGTGAGCCCCACGTTCTGCTTCA
CTCTCCCCATCTCCCCCCCCTCCCCACCCCCAATTTTGTATTTATTTATTTTTTAATTATTTTGTGC
AGCGATGGGGGCGGGGGGGGGGGGGGCGCGCGCCAGGCGGGGCGGGGCGGGGCGAGG
GGCGGGGCGGGGCGAGGCGGAGAGGTGCGGCGGCAGCCAATCAGAGCGGCGCGCTCCGAAA
GTTTCCTTTTATGGCGAGGCGGCGGCGGCGGCGGCCCTATAAAAAGCGAAGCGCGCGGCGGG
CGGGAGTCGCTGCGACGCTGCCTTCGCCCCGTGCCCCGCTCCGCCGCCGCCTCGCGCCGCCC
GCCCCGGCTCTGACTGACCGCGTTACTCCCACAGGTGAGCGGGCGGGACGGCCCTTCTCCTCC
GGGCTGTAATTAGCTGAGCAAGAGGTAAGGGTTTAAGGGATGGTTGGTTGGTGGGGTATTAATG
TTTAATTACCTGGAGCACCTGCCTGAAATCACTTTTTTTCAGGTTGGACCGGTGCCACCATGAAG
AGGACTGCCGATGGATCAGAGTTTGAATCTCCCAAGAAGAAGAGGAAAGTAATCAAGATAGCTA
CAAGGAAGTATCTTGGCAAACAAAACGTTTATGATATTGGAGTCGAAAGAGATCACAACTTTGCT
CTGAAGAACGGATTCATAGCTTCTAATTGCTTCGACTCCGTGGAAATCTCCGGCGTGGAAGATCG
GTTCAACGCCTCCCTGGGCACATACCACGATCTGCTGAAAATTATCAAGGACAAGGACTTCCTG
GACAATGAGGAAAACGAGGACATTCTGGAAGATATCGTGCTGACCCTGACACTGTTTGAGGACA

FIG. 26F (SEQ ID NO: 645 continued)

GAGAGATGATCGAGGAACGGCTGAAAACCTATGCCCACCTGTTCGACGACAAAGTGATGAAGCA
GCTGAAGCGGCGGAGATACACCGGCTGGGGCAGGCTGAGCCGGAAGCTGATCAACGGCATCC
GGGACAAGCAGTCCGGCAAGACAATCCTGGATTTCCTGAAGTCCGACGGCTTCGCCAACAGAAA
CTTCATGCAGCTGATCCACGACGACAGCCTGACCTTTAAAGAGGACATCCAGAAAGCCCAGGTG
TCCGGCCAGGGCGATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGATGGGCCGGCACAAG
CCCGAGAACATCGTGATCGAAATGGCCAGAGAGAACCAGACCACCCAGAAGGGACAGAAGAAC
AGCCGCGAGAGAATGAAGCGGATCGAAGAGGGCATCAAAGAGCTGGGCAGCCAGATCCTGAAA
GAACACCCCGTGGAAAACACCCAGCTGCAGAACGAGAAGCTGTACCTGTACTACCTGCAGAATG
GGCGGGATATGTACGTGGACCAGGAACTGGACATCAACCGGCTGTCCGACTACGATGTGGACC
ATATCGTGCCTCAGAGCTTTCTGAAGGACGACTCCATCGACAACAAGGTGCTGACCAGAAGCGA
CAAGAACCGGGGCAAGAGCGACAACGTGCCCTCCGAAGAGGTCGTGAAGAAGATGAAGAACTA
CTGGCGGCAGCTGCTGAACGCCAAGCTGATTACCCAGAGAAAGTTCGACAATCTGACCAAGGCC
GAGAGAGGCGGCCTGAGCGAACTGGATAAGGCCGGCTTCATCAAGAGACAGCTGGTGGAAACC
CGGCAGATCACAAAGCACGTGGCACAGATCCTGGACTCCCGGATGAACACTAAGTACGACGAGA
ATGACAAGCTGATCCGGGAAGTGAAAGTGATCACCCTGAAGTCCAAGCTGGTGTCCGATTTCCG
GAAGGATTTCCAGTTTTACAAAGTGCGCGAGATCAACAACTACCACCACGCCCACGACGCCTAC
CTGAACGCCGTCGTGGGAACCGCCCTGATCAAAAAGTACCCTAAGCTGGAAAGCGAGTTCGTGT
ACGGCGACTACAAGGTGTACGACGTGCGGAAGATGATCGCCAAGAGCGAGCAGGAAATCGGCA
AGGCTACCGCCAAGTACTTCTTCTACAGCAACATCATGAACTTTTTCAAGACCGAGATTACCCTG
GCCAACGGCGAGATCCGGAAGCGGCCTCTGATCGAGACAAACGGCGAAACCGGGGAGATCGT
GTGGGATAAGGGCCGGGATTTTGCCACCGTGCGGAAAGTGCTGAGCATGCCCCAAGTGAATAT
CGTGAAAAAGACCGAGGTGCAGACAGGCGGCTTCAGCAAAGAGTCTATCCTGCCCAAGAGGAA
CAGCGATAAGCTGATCGCCAGAAAGAAGGACTGGGACCCTAAGAAGTACGGCGGCTTCGACAG
CCCCACCGTGGCCTATTCTGTGCTGGTGGTGGCCAAAGTGGAAAAGGGCAAGTCCAAGAAACTG
AAGAGTGTGAAAGAGCTGCTGGGGATCACCATCATGGAAAGAAGCAGCTTCGAGAAGAATCCCA
TCGACTTTCTGGAAGCCAAGGGCTACAAAGAAGTGAAAAAGGACCTGATCATCAAGCTGCCTAA
GTACTCCCTGTTCGAGCTGGAAAACGGCCGGAAGAGAATGCTGGCCTCTGCCGGCGAACTGCA
GAAGGGAAACGAACTGGCCCTGCCCTCCAAATATGTGAACTTCCTGTACCTGGCCAGCCACTAT
GAGAAGCTGAAGGGCTCCCCCGAGGATAATGAGCAGAAACAGCTGTTTGTGGAACAGCACAAG
CACTACCTGGACGAGATCATCGAGCAGATCAGCGAGTTCTCCAAGAGAGTGATCCTGGCCGACG
CTAATCTGGACAAAGTGCTGTCCGCCTACAACAAGCACCGGGATAAGCCCATCAGAGAGCAGGC
CGAGAATATCATCCACCTGTTTACCCTGACCAATCTGGGAGCCCCTGCCGCCTTCAAGTACTTTG
ACACCACCATCGACCGGAAGAGGTACACCAGCACCAAAGAGGTGCTGGACGCCACCCTGATCC
ACCAGAGCATCACCGGCCTGTACGAGACACGGATCGACCTGTCTCAGCTGGGAGGTGACAGCG
GCGGGAGCGGCGGGAGCGGGGGAGCACTAATCTGAGCGACATCATTGAGAAGGAGACTGGG
AAACAGCTGGTCATTCAGGAGTCCATCCTGATGCTGCCTGAGGAGGTGGAGGAAGTGATCGGCA
ACAAGCCAGAGTCTGACATCCTGGTGCACACCGCCTACGACGAGTCCACAGATGAGAATGTGAT
GCTGCTGACCTCTGACGCCCCCGAGTATAAGCCTTGGGCCCTGGTCATCCAGGATTCTAACGGC
GAGAATAAGATCAAGATGCTGAGCGGAGGATCCAAAAGAACCGCCGACGGCAGCGAATTCGAG
CCCAAGAAGAAGAGGAAAGTCTAAGATCTGATAATCAACCTCTGGATTACAAAATTTGTGAAAGA
TTGACTGGTATTCTTAACTATGTTGCTCCTTTTACGCTATGTGGATACGCTGCTTTAATGCCTTTGT
ATCATGCTATTGCTTCCCGTATGGCTTTCATTTTCTCCTCCTTGTATAAATCCTGGTTAGTTCTTGC
CACGGCGGAACTCATCGCCGCCTGCCTTGCCCGCTGCTGGACAGGGGCTCGGCTGTTGGGCAC
TGACAATTCCGTGGTGCGACTGTGCCTTCTAGTTGCCAGCCATCTGTTGTTTGCCCCTCCCCCGT
GCCTTCCTTGACCCTGGAAGGTGCCACTCCCACTGTCCTTTCCTAATAAAATGAGGAAATTGCAT
CGCATTGTCTGAGTAGGTGTCATTCTATTCTGGGGGGTGGGGTGGGGCAGGACAGCAAGGGGG
AGGATTGGGAAGACAATAGCAGGCATGCTGGGGATGCGGTGGGCTCTATGGCGGCCGCAGG
AACCCCTAGTGATGGAGTTGGCCACTCCCTCTCTGCGCGCTCGCTCGCTCACTGAGGCCGGGC

FIG. 26G (SEQ ID NO: 645 continued)

GACCAAAGGTCGCCCGACGCCCGGGCTTTGCCCGGGCGGCCTCAGTGAGCGAGCGAGCGCGC
AG

ABEmax v5 AAV N-terminal, no pseudospacer (SEQ ID NO: 646)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCTCTGAAGTCGAGTTTAGCCACGAGTATTGGATGAGGCACGCACTGACCCTGGCAAAG
CGAGCATGGGATGAAAGAGAAGTCCCCGTGGGCGCCGTGCTGGTGCACAACAATAGAGTGATC
GGAGAGGGATGGAACAGGCCAATCGGCCGCCACGACCCTACCGCACACGCAGAGATCATGGCA
CTGAGGCAGGGAGGCCTGGTCATGCAGAATTACCGCCTGATCGATGCCACCCTGTATGTGACAC
TGGAGCCATGCGTGATGTGCGCAGGAGCAATGATCCACAGCAGGATCGGAAGAGTGGTGTTCG
GAGCACGGGACGCCAAGACCGGCGCAGCAGGCTCCCTGATGGATGTGCTGCACCACCCCGGC
ATGAACCACCGGGTGGAGATCACAGAGGGAATCCTGGCAGACGAGTGCGCCGCCCTGCTGAGC
GATTTCTTTAGAATGCGGAGACAGGAGATCAAGGCCCAGAAGAAGGCACAGAGCTCCACCGACT
CTGGAGGATCTAGCGGAGGATCCTCTGGAAGCGAGACACCAGGCACAAGCGAGTCCGCCACAC
CAGAGAGCTCCGGCGGCTCCTCCGGAGGATCCTCTGAGGTGGAGTTTTCCCACGAGTACTGGA
TGAGACATGCCCTGACCCTGGCCAAGAGGGCACGCGATGAGAGGGAGGTGCCTGTGGGAGCC
GTGCTGGTGCTGAACAATAGAGTGATCGGCGAGGGCTGGAACAGAGCCATCGGCCTGCACGAC
CCAACAGCCCATGCCGAAATTATGGCCCTGAGACAGGGCGGCCTGGTCATGCAGAACTACAGA
CTGATTGACGCCACCCTGTACGTGACATTCGAGCCTTGCGTGATGTGCGCCGGCGCCATGATCC
ACTCTAGGATCGGCCGCGTGGTGTTTGGCGTGAGGAACGCAAAAACCGGCGCCGCAGGCTCCC
TGATGGACGTGCTGCACTACCCCGGCATGAATCACCGCGTCGAAATTACCGAGGGAATCCTGGC
AGATGAATGTGCCGCCCTGCTGTGCTATTTCTTTCGGATGCCTAGACAGGTGTTCAATGCTCAGA
AGAAGGCCCAGAGCTCCACCGACTCCGGAGGATCTAGCGGAGGCTCCTCTGGCTCTGAGACAC
CTGGCACAAGCGAGAGCGCAACACCTGAAAGCAGCGGGGGCAGCAGCGGGGGGTCAGACAAG
AAGTACAGCATCGGCCTGGCCATCGGCACCAACTCTGTGGGCTGGGCCGTGATCACCGACGAG
TACAAGGTGCCCAGCAAGAAATTCAAGGTGCTGGGCAACACCGACCGGCACAGCATCAAGAAGA
ACCTGATCGGAGCCCTGCTGTTCGACAGCGGCGAAACAGCCGAGGCCACCCGGCTGAAGAGAA
CCGCCAGAAGAAGATACACCAGACGGAAGAACCGGATCTGCTATCTGCAAGAGATCTTCAGCAA
CGAGATGGCCAAGGTGGACGACAGCTTCTTCCACAGACTGGAAGAGTCCTTCCTGGTGGAAGA
GGATAAGAAGCACGAGCGGCACCCCATCTTCGGCAACATCGTGGACGAGGTGGCCTACCACGA
GAAGTACCCCACCATCTACCACCTGAGAAAGAAACTGGTGGACAGCACCGACAAGGCCGACCTG
CGGCTGATCTATCTGGCCCTGGCCCACATGATCAAGTTCCGGGGCCACTTCCTGATCGAGGGC
GACCTGAACCCCGACAACAGCGACGTGGACAAGCTGTTCATCCAGCTGGTGCAGACCTACAACC

FIG. 26H (SEQ ID NO: 646 continued)

AGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATG
GCCTGTTCGGAAACCTGATTGCCCTGAGCCTGGGCCTGACCCCCAACTTCAAGAGCAACTTCGA
CCTGGCCGAGGATGCCAAACTGCAGCTGAGCAAGGACACCTACGACGACGACCTGGACAACCT
GCTGGCCCAGATCGGCGACCAGTACGCCGACCTGTTTCTGGCCGCCAAGAACCTGTCCGACGC
CATCCTGCTGAGCGACATCCTGAGAGTGAACACCGAGATCACCAAGGCCCCCCTGAGCGCCTCT
ATGATCAAGAGATACGACGAGCACCACCAGGACCTGACCCTGCTGAAAGCTCTCGTGCGGCAG
CAGCTGCCTGAGAAGTACAAAGAGATTTTCTTCGACCAGAGCAAGAACGGCTACGCCGGCTACA
TTGACGGCGGAGCCAGCCAGGAAGAGTTCTACAAGTTCATCAAGCCCATCCTGGAAAAGATGGA
CGGCACCGAGGAACTGCTCGTGAAGCTGAACAGAGAGGACCTGCTGCGGAAGCAGCGGACCTT
CGACAACGGCAGCATCCCCCACCAGATCCACCTGGGAGAGCTGCACGCCATTCTGCGGCGGCA
GGAAGATTTTTACCCATTCCTGAAGGACAACCGGGAAAAGATCGAGAAGATCCTGACCTTCCGC
ATCCCCTACTACGTGGGCCCTCTGGCCAGGGGAAACAGCAGATTCGCCTGGATGACCAGAAAG
AGCGAGGAAACCATCACCCCCTGGAACTTCGAGGAAGTGGTGGACAAGGGCGCTTCCGCCCAG
AGCTTCATCGAGCGGATGACCAACTTCGATAAGAACCTGCCCAACGAGAAGGTGCTGCCCAAGC
ACAGCCTGCTGTACGAGTACTTCACCGTGTATAACGAGCTGACCAAAGTGAAATACGTGACCGA
GGGAATGAGAAAGCCCGCCTTCCTGAGCGGCGAGCAGAAAAAGGCCATCGTGGACCTGCTGTT
CAAGACCAACCGGAAAGTGACCGTGAAGCAGCTGAAAGAGGACTACTTCAAGAAAATCGAGTGC
CTGTCCTACGAGACAGAGATCCTGACAGTGGAGTATGGCCTGCTGCCAATCGGCAAGATCGTGG
AGAAGAGGATCGAGTGTACCGTGTACTCTGTGGATAACAATGGCAACATCTATACACAGCCCGT
GGCACAGTGGCACGATAGGGGAGAGCAGGAGGTGTTCGAGTATTGCCTGGAGGACGGCAGCCT
GATCAGGGCAACCAAGGACCACAAGTTCATGACAGTGGATGGCCAGATGCTGCCCATCGACGA
GATTTTCGAGCGGGAGCTGGACCTGATGAGAGTGGATAACCTGCCTAATAGCGGAGGCAGTAAA
AGAACAGCAGACGGGAGTGAGTTTGAGCCCAAGAAAAAGAGAAAGGTGTAAGATCTGATAATCA
ACCTCTGGATTACAAAATTTGTGAAAGATTGACTGGTATTCTTAACTATGTTGCTCCTTTTACGCTA
TGTGGATACGCTGCTTTAATGCCTTTGTATCATGCTATTGCTTCCCGTATGGCTTTCATTTTCTCC
TCCTTGTATAAATCCTGGTTAGTTCTTGCCACGGCGGAACTCATCGCCGCCTGCCTTGCCCGCT
GCTGGACAGGGGCTCGGCTGTTGGGCACTGACAATTCCGTGGTGCGACTGTGCCTTCTAGTTG
CCAGCCATCTGTTGTTTGCCCCTCCCCCGTGCCTTCCTTGACCCTGGAAGGTGCCACTCCCACT
GTCCTTTCCTAATAAAATGAGGAAATTGCATCGCATTGTCTGAGTAGGTGTCATTCTATTCTGGG
GGTGGGGTGGGGCAGGACAGCAAGGGGGAGGATTGGGAAGACAATAGCAGGCATGCTGGGGA
TGCGGTGGGCTCTATGGCGGCCGCAGGAACCCCTAGTGATGGAGTTGGCCACTCCCTCTCTG
CGCGCTCGCTCGCTCACTGAGGCCGGGCGACCAAAGGTCGCCCGACGCCCGGGCTTTGCCCG
GGCGGCCTCAGTGAGCGAGCGAGCGCGCAG

ABEmax v5 AAV C-terminal, Esp3I pseudospacer (SEQ ID NO: 647)

This construct has BsmBI sites flanking an RFP dropout cassette to facilitate selection. Bacteria transformed with uncut parent vector will be RFP-positive.

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGGGCGCGCGCCAGGCG

FIG. 26I (SEQ ID NO: 647 continued)

GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCATCAAGATTGCTACACGGAAATACCTGGAAAGCAGAACGTGTACGACATCGGCGTG
GAGCGGATCACAACTTCGCCCTGAAGAATGGCTTTATCGCCAGCAATTGCTTCGACTCCGTGG
AAATCTCCGGCGTGGAAGATCGGTTCAACGCCTCCCTGGGCACATACCACGATCTGCTGAAAAT
TATCAAGGACAAGGACTTCCTGGACAATGAGGAAAACGAGGACATTCTGGAAGATATCGTGCTG
ACCCTGACACTGTTTGAGGACAGAGAGATGATCGAGGAACGGCTGAAAACCTATGCCCACCTGT
TCGACGACAAAGTGATGAAGCAGCTGAAGCGGCGGAGATACACCGGCTGGGGCAGGCTGAGCC
GGAAGCTGATCAACGGCATCCGGGACAAGCAGTCCGGCAAGACAATCCTGGATTTCCTGAAGTC
CGACGGCTTCGCCAACAGAAACTTCATGCAGCTGATCCACGACGACAGCCTGACCTTTAAAGAG
GACATCCAGAAAGCCCAGGTGTCCGGCCAGGGCGATAGCCTGCACGAGCACATTGCCAATCTG
GCCGGCAGCCCCGCCATTAAGAAGGGCATCCTGCAGACAGTGAAGGTGGTGGACGAGCTCGTG
AAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAG
CTGGGCAGCCAGATCCTGAAAGAACACCCCGTGGAAAACACCCAGCTGCAGAACGAGAAGCTG
TACCTGTACTACCTGCAGAATGGCCGGGATATGTACGTGGACCAGGAACTGGACATCAACCGGC
TGTCCGACTACGATGTGGACCATATCGTGCCTCAGAGCTTTCTGAAGGACGACTCCATCGACAA
CAAGGTGCTGACCAGAAGCGACAAGAACCGGGGCAAGAGCGACAACGTGCCCTCCGAAGAGGT
CGTGAAGAAGATGAAGAACTACTGGCGGCAGCTGCTGAACGCCAAGCTGATTACCCAGAGAAAG
TTCGACAATCTGACCAAGGCCGAGAGAGGCGGCCTGAGCGAACTGGATAAGGCCGGCTTCATC
AAGAGACAGCTGGTGGAAACCCGGCAGATCACAAAGCACGTGGCACAGATCCTGGACTCCCGG
ATGAACACTAAGTACGACGAGAATGACAAGCTGATCCGGGAAGTGAAAGTGATCACCCTGAAGT
CCAAGCTGGTGTCCGATTTCCGGAAGGATTTCCAGTTTTACAAAGTGCGCGAGATCAACAACTAC
CACCACGCCCACGACGCCTACCTGAACGCCGTCGTGGGAACCGCCCTGATCAAAAAGTACCCTA
AGCTGGAAAGCGAGTTCGTGTACGGCGACTACAAGGTGTACGACGTGCGGAAGATGATCGCCA
AGAGCGAGCAGGAAATCGGCAAGGCTACCGCCAAGTACTTCTTCTACAGCAACATCATGAACTTT
TTCAAGACCGAGATTACCCTGGCCAACGGCGAGATCCGGAAGCGGCCTCTGATCGAGACAAAC
GGCGAAACCGGGGAGATCGTGTGGGATAAGGGCCGGGATTTTGCCACCGTGCGGAAAGTGCTG
AGCATGCCCCAAGTGAATATCGTGAAAAAGACCGAGGTGCAGACAGGCGGCTTCAGCAAAGAGT
CTATCCTGCCCAAGAGGAACAGCGATAAGCTGATCGCCAGAAAGAAGGACTGGGACCCTAAGAA
GTACGGCGGCTTCGACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCATCATGGAAAGAAGC
AGCTTCGAGAAGAATCCCATCGACTTTCTGGAAGCCAAGGGCTACAAAGAAGTGAAAAAGGACC
TGATCATCAAGCTGCCTAAGTACTCCCTGTTCGAGCTGGAAAACGGCCGGAAGAGAATGCTGGC
CTCTGCCGGCGAACTGCAGAAGGGAAACGAACTGGCCCTGCCCTCCAAATATGTGAACTTCCTG
TACCTGGCCAGCCACTATGAGAAGCTGAAGGGCTCCCCCGAGGATAATGAGCAGAAACAGCTGT
TTGTGGAACAGCACAAGCACTACCTGGACGAGATCATCGAGCAGATCAGCGAGTTCTCCAAGAG
AGTGATCCTGGCCGACGCTAATCTGGACAAAGTGCTGTCCGCCTACAACAAGCACCGGGATAAG
CCCATCAGAGAGCAGGCCGAGAATATCATCCACCTGTTTACCCTGACCAATCTGGGAGCCCCTG
CCGCCTTCAAGTACTTTGACACCACCATCGACCGGAAGAGGTACACCAGCACCAAAGAGGTGCT
GGACGCCACCCTGATCCACCAGAGCATCACCGGCCTGTACGAGACACGGATCGACCTGTCTCA
GCTGGGAGGTGACTCTGGCGGCTCAAAAAGAACCGCCGACGGCAGCGAATTCGAGCCCAAGAA
GAAGAGGAAAGTCTAAGATCTGATAATCAACCTCTGGATTACAAAATTTGTGAAAGATTGACTGGT
ATTCTTAACTATGTTGCTCCTTTTACGCTATGTGGATACGCTGCTTTAATGCCTTTGTATCATGCTA

FIG. 26J (SEQ ID NO: 647 continued)

TTGCTTCCCGTATGGCTTTCATTTTCTCCTCCTTGTATAAATCCTGGTTAGTTCTTGCCACGGCGG
AACTCATCGCCGCCTGCCTTGCCCGCTGCTGGACAGGGGCTCGGCTGTTGGGCACTGACAATT
CCGTGGTGCGACTGTGCCTTCTAGTTGCCAGCCATCTGTTGTTTGCCCCTCCCCCGTGCCTTCC
TTGACCCTGGAAGGTGCCACTCCCACTGTCCTTTCCTAATAAAATGAGGAAATTGCATCGCATTG
TCTGAGTAGGTGTCATTCTATTCTGGGGGGTGGGGTGGGGCAGGACAGCAAGGGGGAGGATTG
GGAAGACAATAGCAGGCATGCTGGGGATGCGGTGGGCTCTATGGCTCGAGAAAAAAAGCACCG
ACTCGGTGCCACTTTTTCAAGTTGATAACGGACTAGCCTTATTTTAACTTGCTATTTCTAGCTCTA
AAACCGAGACGTATAAACGCAGAAAGGCCCACCCGAAGGTGAGCCAGTGTGACTCTAGTAGAGA
GCGTTCACCGACAAACAACAGATAAAACGAAAGGCCCAGTCTTTCGACTGAGCCTTTCGTTTTAT
TTGATGCCTGGAGATCCTTATTAAGCACCCGTGGAGTGACGACCTTCAGCACGTTCGTACTGTTC
AACGATGGTGTAGTCTTCGTTGTGGGAGGTGATGTCCAGTTTGATGTCGGTTTTGTAAGCACCCG
GCAGCTGAACGGGTTTTTTAGCCATGTAGGTGGTTTTAACTTCAGCGTCGTAGTGACCACCGTCT
TTCAGTTTCAGACGCATTTTGATTTCACCTTTCAGAGCACCGTCTTCCGGGTACATACGTTCGGT
GGAAGCTTCCCAACCCATGGTTTTTTTCTGCATAACCGGACCGTCGGACGGGAAGTTGGTACCA
CGCAGTTTAACTTTGTAGATGAACTCACCGTCTTGCAGGGAGGAGTCCTGGGTAACGGTAACAA
CACCACCGTCTTCGAAGTTCATAACACGTTCCCATTTGAAACCTTCCGGGAAGGACAGTTTCAGG
TAGTCCGGGATGTCAGCCGGGTGTTTAACGTAAGCTTTGGAACCGTACTGGAACTGCGGGGACA
GGATGTCCCAAGCGAACGGCAGCGGACCACCTTTGGTAACTTTCAGTTTAGCGGTCTGGGTACC
TTCGTACGGACGACCTTCACCTTCACCTTCGATTTCGAACTCGTGACCGTTAACGGAACCTTCCA
TACGAACTTTGAAACGCATGAACTCTTTGATAACGTCTTCGCTACTCGCCATAGATCCTTTCTCCT
CTTTCAGATCCGTGCTCAGTATCTCTATCACTGATAGGGATGTCAATCTCTATCACTGATAGGGA
CGTCTCGGGTGTTTCGTCCTTTCCACAAGATATATAAAGCCAAGAAATCGAAATACTTTCAAGTTA
CGGTAAGCATATGATAGTCCATTTTAAAACATAATTTTAAAACTGCAAACTACCCAAGAAATTATTA
CTTTCTACGTCACGTATTTTGTACTAATATCTTTGTGTTTACAGTCAAATTAATTCTAATTATCTCTC
TAACAGCCTTGTATCGTATATGCAAATATGAAGGAATCATGGGAAATAGGCCCTCTTCCTGCCCG
ACCTTGCGGCCGCAGGAACCCCTAGTGATGGAGTTGGCCACTCCCTCTCTGCGCGCTCGCTCG
CTCACTGAGGCCGGGCGACCAAAGGTCGCCCGACGCCCGGGCTTTGCCCGGGCGGCCTCAGT
GAGCGAGCGAGCGCGCAG

CBE3.9max v5 AAV N-terminal, Esp3I pseudospacer (SEQ ID NO: 648)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCTCCTCAGAGACTGGGCCTGTCGCCGTCGATCCAACCCTGCGCCGCCGGATTGAACC

FIG. 26K (SEQ ID NO: 648 continued)

TCACGAGTTTGAAGTGTTCTTTGACCCCCGGAGCTGAGAAAGGAGACATGCCTGCTGTACGAG
ATCAACTGGGAGGCAGGCACTCCATCTGGAGGCACACCTCTCAGAACACAAATAAGCACGTGG
AGGTGAACTTCATCGAGAAGTTTACCACAGAGCGGTACTTCTGCCCCAATACCAGATGTAGCATC
ACATGGTTTCTGAGCTGGTCCCCTTGCGGAGAGTGTAGCAGGGCCATCACCGAGTTCCTGTCCA
GATATCCACACGTGACACTGTTTATCTACATCGCCAGGCTGTATCACCACGCAGACCCAAGGAAT
AGGCAGGGCCTGCGCGATCTGATCAGCTCCGGCGTGACCATCCAGATCATGACAGAGCAGGAG
TCCGGCTACTGCTGGCGGAACTTCGTGAATTATTCTCCTAGCAACGAGGCCCACTGGCCTAGGT
ACCCACACCTGTGGGTGCGCCTGTACGTGCTGGAGCTGTATTGCATCATCCTGGGCCTGCCCCC
TTGTCTGAATATCCTGCGGAGAAAGCAGCCCCAGCTGACCTTCTTTACAATCGCCCTGCAGTCTT
GTCACTATCAGAGGCTGCCACCCCACATCCTGTGGGCCACAGGCCTGAAGTCTGGAGGATCTAG
CGGAGGATCCTCTGGCAGCGAGACACCAGGAACAAGCGAGTCAGCAACACCAGAGAGCAGTGG
CGGCAGCAGCGGCGGCAGCGACAAGAAGTACAGCATCGGCCTGGCCATCGGCACCAACTCTGT
GGGCTGGGCCGTGATCACCGACGAGTACAAGGTGCCCAGCAAGAAATTCAAGGTGCTGGGCAA
CACCGACCGGCACAGCATCAAGAAGAACCTGATCGGAGCCCTGCTGTTCGACAGCGGCGAAAC
AGCCGAGGCCACCCGGCTGAAGAGAACCGCCAGAAGAAGATACACCAGACGGAAGAACCGGAT
CTGCTATCTGCAAGAGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCCCATCTTCGGCAAC
ATCGTGGACGAGGTGGCCTACCACGAGAAGTACCCCACCATCTACCACCTGAGAAAGAAACTGG
TGGACAGCACCGACAAGGCCGACCTGCGGCTGATCTATCTGGCCCTGGCCCACATGATCAAGTT
CCGGGGCCACTTCCTGATCGAGGGCGACCTGAACCCCGACAACAGCGACGTGGACAAGCTGTT
CATCCAGCTGGTGCAGACCTACAACCAGCTGTTCGAGGAAAACCCCATCAACGCCAGCGGCGT
GGACGCCAAGGCCATCCTGTCTGCCAGACTGAGCAAGAGCAGACGGCTGGAAAATCTGATCGC
CCAGCTGCCCGGCGAGAAGAAGAATGGCCTGTTCGGAAACCTGATTGCCCTGAGCCTGGGCCT
GACCCCCAACTTCAAGAGCAACTTCGACCTGGCCGAGGATGCCAAACTGCAGCTGAGCAAGGA
CACCTACGACGACGACCTGGACAACCTGCTGGCCCAGATCGGCGACCAGTACGCCGACCTGTT
TCTGGCCGCCAAGAACCTGTCCGACGCCATCCTGCTGAGCGACATCCTGAGAGTGAACACCGA
GATCACCAAGGCCCCCCTGAGCGCCTCTATGATCAAGAGATACGACGAGCACCACCAGGACCT
GACCCTGCTGAAAGCTCTCGTGCGGCAGCAGCTGCCTGAGAAGTACAAAGAGATTTTCTTCGAC
CAGAGCAAGAACGGCTACGCCGGCTACATTGACGGCGGAGCCAGCCAGGAAGAGTTCTACAAG
TTCATCAAGCCCATCCTGGAAAAGATGGACGGCACCGAGGAACTGCTCGTGAAGCTGAACAGAG
AGGACCTGCTGCGGAAGCAGCGGACCTTCGACAACGGCAGCATCCCCCACCAGATCCACCTGG
GAGAGCTGCACGCCATTCTGCGGCGGCAGGAAGATTTTTACCCATTCCTGAAGGACAACCGGGA
AAAGATCGAGAAGATCCTGACCTTCCGCATCCCCTACTACGTGGGCCCTCTGGCCAGGGGAAAC
AGCAGATTCGCCTGGATGACCAGAAAGAGCGAGGAAACCATCACCCCCTGGAACTTCGAGGAA
GTGGTGGACAAGGGCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTTCACCGTGTATAACG
AGCTGACCAAAGTGAAATACGTGACCGAGGGAATGAGAAAGCCCGCCTTCCTGAGCGGCGAGC
AGAAAAAGGCCATCGTGGACCTGCTGTTCAAGACCAACCGGAAAGTGACCGTGAAGCAGCTGAA
AGAGGACTACTTCAAGAAAATCGAGTGCCTGTCCTACGAGACAGAGATCCTGACAGTGGAGTAT
GGCCTGCTGCCAATCGGCAAGATCGTGGAGAAGAGGATCGAGTGTACCGTGTACTCTGTGGATA
ACAATGGCAACATCTATACACAGCCCGTGGCACAGTGGCACGATAGGGGAGAGCAGGAGGTGT
TCGAGTATTGCCTGGAGGACGGCAGCCTGATCAGGGCAACCAAGGACCACAAGTTCATGACAGT
GGATGGCCAGATGCTGCCCATCGACGAGATTTTCGAGCGGGAGCTGGACCTGATGAGAGTGGA
TAACCTGCCTAATAGCGGAGGCAGTAAAAGAACAGCAGACGGGAGTGAGTTTGAGCCCAAGAAA
AAGAGAAAGGTGTAAGATCTGATAATCAACCTCTGGATTACAAAATTTGTGAAAGATTGACTGGTA
TTCTTAACTATGTTGCTCCTTTTACGCTATGTGGATACGCTGCTTTAATGCCTTTGTATCATGCTAT
TGCTTCCCGTATGGCTTTCATTTTCTCCTCCTTGTATAAATCCTGGTTAGTTCTTGCCACGGCGGA
ACTCATCGCCGCCTGCCTTGCCCGCTGCTGGACAGGGGCTCGGCTGTTGGGCACTGACAATTC
CGTGGTGCGACTGTGCCTTCTAGTTGCCAGCCATCTGTTGTTTGCCCCTCCCCCGTGCCTTCCTT

FIG. 26L (SEQ ID NO: 648 continued)

GACCCTGGAAGGTGCCACTCCCACTGTCCTTTCCTAATAAAATGAGGAAATTGCATCGCATTGTC
TGAGTAGGTGTCATTCTATTCTGGGGGGTGGGGTGGGGCAGGACAGCAAGGGGGAGGATTGGG
AAGACAATAGCAGGCATGCTGGGGATGCGGTGGGCTCTATGGCTCGAGAAAAAAGCACCGAC
TCGGTGCCACTTTTTCAAGTTGATAACGGACTAGCCTTATTTTAACTTGCTATTTCTAGCTCTAAAA
CCGAGACGCATTAATCGTCTCGGGTGTTTCGTCCTTTCCACAAGATATATAAAGCCAAGAAATCG
AAATACTTTCAAGTTACGGTAAGCATATGATAGTCCATTTTAAAACATAATTTTAAAACTGCAAACT
ACCCAAGAAATTATTACTTTCTACGTCACGTATTTTGTACTAATATCTTTGTGTTTACAGTCAATT
AATTCTAATTATCTCTCTAACAGCCTTGTATCGTATATGCAAATATGAAGGAATCATGGGAAATAG
GCCCTCTTCCTGCCCGACCTTGCGGCCGCAGGAACCCCTAGTGATGGAGTTGGCCACTCCCTCT
CTGCGCGCTCGCTCGCTCACTGAGGCCGGGCGACCAAAGGTCGCCCGACGCCCGGGCTTTGC
CCGGGCGGCCTCAGTGAGCGAGCGAGCGCGCAG

CBE3.9max v5 AAV C-terminal, Esp3I pseudospacer (SEQ ID NO: 649)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCATCAAGATTGCTACACGGAAATACCTGGGAAAGCAGAACGTGTACGACATCGGCGTG
GAGCGGGATCACAACTTCGCCCTGAAGAATGGCTTTATCGCCAGCAATTGCTTCGACTCCGTGG
AAATCTCCGGCGTGGAAGATCGGTTCAACGCCTCCCTGGGCACATACCACGATCTGCTGAAAAT
TATCAAGGACAAGGACTTCCTGGACAATGAGGAAAACGAGGACATTCTGGAAGATATCGTGCTG
ACCCTGACACTGTTTGAGGACAGAGAGATGATCGAGGAACGGCTGAAAACCTATGCCCACCTGT
TCGACGACAAAGTGATGAAGCAGCTGAAGCGGCGGAGATACACCGGCTGGGGCAGGCTGAGCC
GGAAGCTGATCAACGGCATCCGGGACAAGCAGTCCGGCAAGACAATCCTGGATTTCCTGAAGTC
CGACGGCTTCGCCAACAGAAACTTCATGCAGCTGATCCACGACGACAGCCTGACCTTTAAAGAG
GACATCCAGAAAGCCCAGGTGTCCGGCCAGGGCGATAGCCTGCACGAGCACATTGCCAATCTG
GCCGGCAGCCCCGCCATTAAGAAGGGCATCCTGCAGACAGTGAAGGTGGTGGACGAGCTCGTG
AAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAG
CTGGGCAGCCAGATCCTGAAAGAACACCCCGTGGAAAACACCCAGCTGCAGAACGAGAAGCTG
TACCTGTACTACCTGCAGAATGGGCGGGATATGTACGTGGACCAGGAACTGGACATCAACCGGC
TGTCCGACTACGATGTGGACCATATCGTGCCTCAGAGCTTTCTGAAGGACGACTCCATCGACAA
CAAGGTGCTGACCAGAAGCGACAAGAACCGGGGCAAGAGCGACAACGTGCCCTCCGAAGAGGT
CGTGAAGAAGATGAAGAACTACTGGCGGCAGCTGCTGAACGCCAAGCTGATTACCCAGAGAAAG
TTCGACAATCTGACCAAGGCCGAGAGAGGCGGCCTGAGCGAACTGGATAAGGCCGGCTTCATC

FIG. 26M (SEQ ID NO: 649 continued)

AAGAGACAGCTGGTGGAAACCCGGCAGATCACAAAGCACGTGGCACAGATCCTGGACTCCCGG
ATGAACACTAAGTACGACGAGAATGACAAGCTGATCCGGGAAGTGAAAGTGATCACCCTGAAGT
CCAAGCTGGTGTCCGATTTCCGGAAGGATTTCCAGTTTTACAAAGTGCGCGAGATCAACAACTAC
CACCACGCCCACGACGCCTACCTGAACGCCGTCGTGGGAACCGCCCTGATCAAAAAGTACCCTA
AGCTGGAAAGCGAGTTCGTGTACGGCGACTACAAGGTGTACGACGTGCGGAAGATGATCGCCA
AGAGCGAGCAGGAAATCGGCAAGGCTACCGCCAAGTACTTCTTCTACAGCAACATCATGAACTTT
TTCAAGACCGAGATTACCCTGGCCAACGGCGAGATCCGGAAGCGGCCTCTGATCGAGACAAAC
GGCGAAACCGGGGAGATCGTGTGGGATAAGGGCCGGGATTTTGCCACCGTGCGGAAAGTGCTG
AGCATGCCCCAAGTGAATATCGTGAAAAAGACCGAGGTGCAGACAGGCGGCTTCAGCAAAGAGT
CTATCCTGCCCAAGAGGAACAGCGATAAGCTGATCGCCAGAAAGAAGGACTGGGACCCTAAGAA
GTACGGCGGCTTCGACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCATCATGGAAAGAAGC
AGCTTCGAGAAGAATCCCATCGACTTTCTGGAAGCCAAGGGCTACAAAGAAGTGAAAAAGGACC
TGATCATCAAGCTGCCTAAGTACTCCCTGTTCGAGCTGGAAAACGGCCGGAAGAGAATGCTGGC
CTCTGCCGGCGAACTGCAGAAGGGAAACGAACTGGCCCTGCCCTCCAAATATGTGAACTTCCTG
TACCTGGCCAGCCACTATGAGAAGCTGAAGGGCTCCCCCGAGGATAATGAGCAGAAACAGCTGT
TTGTGGAACAGCACAAGCACTACCTGGACGAGATCATCGAGCAGATCAGCGAGTTCTCCAAGAG
AGTGATCCTGGCCGACGCTAATCTGGACAAAGTGCTGTCCGCCTACAACAAGCACCGGGATAAG
CCCATCAGAGAGCAGGCCGAGAATATCATCCACCTGTTTACCCTGACCAATCTGGGAGCCCCTG
CCGCCTTCAAGTACTTTGACACCACCATCGACCGGAAGAGGTACACCAGCACCAAAGAGGTGCT
GGACGCCACCCTGATCCACCAGAGCATCACCGGCCTGTACGAGACACGGATCGACCTGTCTCA
GCTGGGAGGTGACAGCGGCGGGAGCGGCGGGAGCGGGGGGAGCACTAATCTGAGCGACATCA
TTGAGAAGGAGACTGGGAAACAGCTGGTCATTCAGGAGTCCATCCTGATGCTGCCTGAGGAGGT
GGAGGAAGTGATCGGCAACAAGCCAGAGTCTGACATCCTGGTGCACACCGCCTACGACGAGTC
CACAGATGAGAATGTGATGCTGCTGACCTCTGACGCCCCCGAGTATAAGCCTTGGGCCCTGGTC
ATCCAGGATTCTAACGGCGAGAATAAGATCAAGATGCTGAGCGGAGGATCCAAAAGAACCGCCG
ACGGCAGCGAATTCGAGCCCAAGAAGAAGAGGAAAGTCTAAGATCTGATAATCAACCTCTGGAT
TACAAAATTTGTGAAAGATTGACTGGTATTCTTAACTATGTTGCTCCTTTTACGCTATGTGGATAC
GCTGCTTTAATGCCTTTGTATCATGCTATTGCTTCCCGTATGGCTTTCATTTTCTCCTCCTTGTATA
AATCCTGGTTAGTTCTTGCCACGGCGGAACTCATCGCCGCCTGCCTTGCCCGCTGCTGGACAGG
GGCTCGGCTGTTGGGCACTGACAATTCCGTGGTGCGACTGTGCCTTCTAGTTGCCAGCCATCTG
TTGTTTGCCCCTCCCCCGTGCCTTCCTTGACCCTGGAAGGTGCCACTCCCACTGTCCTTTCCTAA
TAAAATGAGGAAATTGCATCGCATTGTCTGAGTAGGTGTCATTCTATTCTGGGGGGTGGGGTGG
GGCAGGACAGCAAGGGGGAGGATTGGGAAGACAATAGCAGGCATGCTGGGGATGCGGTGGGC
TCTATGGCTCGAGAAAAAAAGCACCGACTCGGTGCCACTTTTTCAAGTTGATAACGGACTAGCCT
TATTTTAACTTGCTATTTCTAGCTCTAAAACCGAGACGCATTAATCGTCTCGGGTGTTTCGTCCTT
TCCACAAGATATATAAAGCCAAGAAATCGAAATACTTTCAAGTTACGGTAAGCATATGATAGTCCA
TTTTAAAACATAATTTTAAAACTGCAAACTACCCAAGAAATTATTACTTTCTACGTCACGTATTTTGT
ACTAATATCTTTGTGTTTACAGTCAAATTAATTCTAATTATCTCTCTAACAGCCTTGTATCGTATAT
GCAAATATGAAGGAATCATGGGAAATAGGCCCTCTTCCTGCCCGACCTTGCGGCCGCAGGAACC
CCTAGTGATGGAGTTGGCCACTCCCTCTCTGCGCGCTCGCTCGCTCACTGAGGCCGGGCGACC
AAAGGTCGCCCGACGCCCGGGCTTTGCCCGGGCGGCCTCAGTGAGCGAGCGAGCGCGCAG saCBE3.9max v5 AAV N-terminal, Esp3I pseudospacer (SEQ ID NO: 650)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG

FIG. 26N (SEQ ID NO: 650 continued)

TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCTCCTCAGAGACTGGCCTGTCGCCGTCGATCCAACCCTGCGCCGCCGGATTGAACC
TCACGAGTTTGAAGTGTTCTTTGACCCCGGGAGCTGAGAAAGGAGACATGCCTGCTGTACGAG
ATCAACTGGGGAGGCAGGCACTCCATCTGGAGGCACACCTCTCAGAACACAAATAAGCACGTGG
AGGTGAACTTCATCGAGAAGTTTACCACAGAGCGGTACTTCTGCCCCAATACCAGATGTAGCATC
ACATGGTTTCTGAGCTGGTCCCCTTGCGGAGAGTGTAGCAGGGCCATCACCGAGTTCCTGTCCA
GATATCCACACGTGACACTGTTTATCTACATCGCCAGGCTGTATCACCACGCAGACCCAAGGAAT
AGGCAGGGCCTGCGCGATCTGATCAGCTCCGGCGTGACCATCCAGATCATGACAGAGCAGGAG
TCCGGCTACTGCTGGCGGAACTTCGTGAATTATTCTCCTAGCAACGAGGCCCACTGGCCTAGGT
ACCCACACCTGTGGGTGCGCCTGTACGTGCTGGAGCTGTATTGCATCATCCTGGGCCTGCCCCC
TTGTCTGAATATCCTGCGGAGAAAGCAGCCCCAGCTGACCTTCTTTACAATCGCCCTGCAGTCTT
GTCACTATCAGAGGCTGCCACCCCACATCCTGTGGGCCACAGGCCTGAAGTCTGGAGGATCTAG
CGGAGGATCCTCTGGCAGCGAGACACCAGGAACAAGCGAGTCAGCAACACCAGAGAGCAGTGG
CGGCAGCAGCGGCGGCAGCGGAAGCGAAATTACATTCTGGGGCTGGCCATTGGCATTACATC
AGTGGGCTATGGCATCATTGACTACGAGACAAGGGACGTGATCGACGCCGGCGTGAGACTGTT
CAAGGAGGCCAACGTGGAGAACAATGAGGGCCGGAGATCCAAGAGGGGAGCAAGGCGCCTGA
AGCGGAGAAGGCGCCACAGAATCCAGAGAGTGAAGAAGCTGCTGTTCGATTACAACCTGCTGAC
CGACCACTCCGAGCTGTCTGGCATCAATCCTTATGAGGCCAGAGTGAAGGGCCTGTCCCAGAAG
CTGTCTGAGGAGGAGTTTAGCGCCGCCCTGCTGCACCTGGCAAAGAGGAGAGGCGTGCACAAC
GTGAATGAGGTGGAGGAGGACACCGGCAACGAGCTGTCCACAAAGGAGCAGATCAGCCGCAAT
TCCAAGGCCCTGGAGGAGAAGTATGTGGCCGAGCTGCAGCTGGAGCGGCTGAAGAAGGATGGC
GAGGTGAGGGGCTCCATCAATCGCTTCAAGACCTCTGACTACGTGAAGGAGGCCAAGCAGCTG
CTGAAGGTGCAGAAGGCCTACCACCAGCTGGATCAGTCCTTTATCGATACATATATCGACCTGCT
GGAGACAAGGCGCACATACTATGAGGGACCAGGAGAGGGCTCTCCCTTCGGCTGGAAGGACAT
CAAGGAGTGGTACGAGATGCTGATGGGCCACTGCACCTATTTTCCAGAGGAGCTGAGAAGCGTG
AAGTACGCCTATAACGCCGATCTGTACAACGCCCTGAATGACCTGAACAACCTGGTCATCACCA
GGGATGAGAACGAGAAGCTGGAGTACTATGAGAAGTTCCAGATCATCGAGAACGTGTTCAAGCA
GAAGAAGAAGCCTACACTGAAGCAGATCGCCAAGGAGATCCTGGTGAACGAGGAGGACATCAA
GGGCTACCGCGTGACCTCCACAGGCAAGCCAGAGTTCACCAATCTGAAGGTGTATCACGATATC
AAGGACATCACAGCCCGGAAGGAGATCATCGAGAACGCCGAGCTGCTGGATCAGATCGCCAAG
ATCCTGACCATCTATCAGAGCTCCGAGGACATCCAGGAGGAGCTGACCAACCTGAATAGCGAGC
TGACACAGGAGGAGATCGAGCAGATCAGCAATCTGAAGGGCTACACCGGCACACACAACCTGA
GCCTGAAGGCCATCAATCTGATCCTGGATGAGCTGTGGCACACAAACGACAATCAGATCGCCAT
CTTTAACCGGCTGAAGCTGGTGCCAAAGAAGGTGGACCTGTCCCAGCAGAAGGAGATCCCAACC
ACACTGGTGGACGATTTCATCCTGTCTCCCGTGGTGAAGCGGAGCTTCATCCAGAGCATCAAAG
TGATCAACGCCATCATCAAGAAGTACGGCCTGCCCAATGATATCATCATCGAGCTGGCCAGGGA
GAAGAACTCCAAGGACGCCCAGAAGATGATCAATGAGATGCAGAAGAGGAACCGCCAGACCAAT
GAGCGGATCGAGGAGATCATCAGAACCACAGGCAAGGAGAACGCCAAGTACCTGATCGAGAAG
ATCAAGCTGCACGATATGCAGGAGGGCAAGTGCCTGTCCTACGAGACAGAGATCCTGACAGTGG

FIG. 26O (SEQ ID NO: 650 continued)

AGTATGGCCTGCTGCCAATCGGCAAGATCGTGGAGAAGAGGATCGAGTGTACCGTGTACTCTGT
GGATAACAATGGCAACATCTATACACAGCCCGTGGCACAGTGGCACGATAGGGGAGAGCAGGA
GGTGTTCGAGTATTGCCTGGAGGACGGCAGCCTGATCAGGGCAACCAAGGACCACAAGTTCAT
GACGATGGATGGCCAGATGCTGCCCATCGACGAGATTTTCGAGCGGGAGCTGGACCTGATGAG
AGTGGATAACCTGCCTAATAGCGGAGGCAGTAAAAGAACAGCAGACGGGAGTGAGTTTGAGCCC
AAGAAAAAGAGAAAGGTGTAAGATCTGATAATCAACCTCTGGATTACAAAATTTGTGAAAGATTGA
CTGGTATTCTTAACTATGTTGCTCCTTTTACGCTATGTGGATACGCTGCTTTAATGCCTTTGTATCA
TGCTATTGCTTCCCGTATGGCTTTCATTTTCTCCTCCTTGTATAAATCCTGGTTAGTTCTTGCCAC
GGCGGAACTCATCGCCGCCTGCCTTGCCCGCTGCTGGACAGGGGCTCGGCTGTTGGGCACTGA
CAATTCCGTGGTGCGACTGTGCCTTCTAGTTGCCAGCCATCTGTTGTTTGCCCCTCCCCCGTGC
CTTCCTTGACCCTGGAAGGTGCCACTCCCACTGTCCTTTCCTAATAAAATGAGGAAATTGCATCG
CATTGTCTGAGTAGGTGTCATTCTATTCTGGGGGGTGGGGTGGGGCAGGACAGCAAGGGGGAG
GATTGGGAAGACAATAGCAGGCATGCTGGGGATGCGGTGGGCTCTATGGCTCGAGAAAAAAATC
TCGCCAACAAGTTGACGAGATAAACACGGCATTTTGCCTTGTTTTAGTAGATTCTGTAATTTTCAT
TACAGAGTACTAAAACCGAGACGCATTAATCGTCTCGGGTGTTTCGTCCTTTCCACAAGATATATA
AAGCCAAGAAATCGAAATACTTTCAAGTTACGGTAAGCATATGATAGTCCATTTTAAAACATAATTT
TAAAACTGCAAACTACCCAAGAAATTATTACTTTCTACGTCACGTATTTTGTACTAATATCTTTGTG
TTTACAGTCAAATTAATTCTAATTATCTCTCTAACAGCCTTGTATCGTATATGCAAATATGAAGGAA
TCATGGGAAATAGGCCCTCTTCCTGCCCGACCTTGCGGCCCGCAGGAACCCCTAGTGATGGAGTT
GGCCACTCCCTCTCTGCGCGCTCGCTCGCTCACTGAGGCCGGGCGACCAAAGGTCGCCCGACG
CCCGGGCTTTGCCCGGGCGGCCTCAGTGAGCGAGCGAGCGCGCAG saCBE3.9max v5 AAV C-terminal, Esp3I pseudospacer

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCATCAAGATTGCTACACGGAAATACCTGGAAAGCAGAACGTGTACGACATCGGCGTG
GAGCGGGATCACAACTTCGCCCTGAAGAATGGCTTTATCGCCAGCAATTGTCTGTATTCTCTGGA
GGCCATCCCTCTGGAGGACCTGCTGAACAATCCATTCAACTACGAGGTGGATCACATCATCCCC
CGGAGCGTGAGCTTCGACAATTCTTTTAACAATAAGGTGCTGGTGAAGCAGGAGGAGAACAGCA
AGAAGGGCAATAGGACCCCTTTCCAGTACCTGTCTAGCTCCGATTCTAAGATCAGCTACGAGACA
TTCAAGAAGCACATCCTGAATCTGGCCAAGGGCAAGGGCCGCATCAGCAAGACCAAGAAGGAGT
ACCTGCTGGAGGAGCGGGACATCAACAGATTCTCCGTGCAGAAGGACTTCATCAACCGGAATCT
GGTGGACACCAGATACGCCACACGCGGCCTGATGAATCTGCTGCGGTCTTATTTCAGAGTGAAC
AATCTGGATGTGAAGGTGAAGAGCATCAACGGCGGCTTCACCTCCTTTCTGCGGAGAAAGTGGA
AGTTTAAGAAGGAGCGCAACAAGGGCTATAAGCACCACGCCGAGGATGCCCTGATCATCGCCAA

FIG. 26P (SEQ ID NO: 651 continued)

TGCCGACTTCATCTTTAAGGAGTGGAAGAAGCTGGACAAGGCCAAGAAAGTGATGGAGAACCAG
ATGTTCGAGGAGAAGCAGGCCGAGAGCATGCCCGAGATCGAGACAGAGCAGGAGTACAAGGAG
ATTTTCATCACACCTCACCAGATCAAGCACATCAAGGACTTCAAGGACTACAAGTATTCTCACAG
GGTGGATAAGAAGCCCAACCGCGAGCTGATCAATGACACCCTGTATAGCACACGGAAGGACGAT
AAGGGCAATACCCTGATCGTGAACAATCTGAACGGCCTGTACGACAAGGATAATGACAAGCTGA
AGAAGCTGATCAACAAGTCTCCCGAGAAGCTGCTGATGTACCACCACGATCCTCAGACATATCA
GAAGCTGAAGCTGATCATGGAGCAGTACGGCGACGAGAAGAACCCACTGTATAAGTACTATGAG
GAGACAGGCAACTACCTGACAAAGTATAGCAAGAAGGATAATGGCCCCGTGATCAAGAAGATCA
AGTACTATGGCAACAAGCTGAATGCCCACCTGGACATCACCGACGATTACCCTAACTCTCGCAAT
AAGGTGGTGAAGCTGAGCCTGAAGCCATACCGGTTCGACGTGTACCTGGACAACGGCGTGTATA
AGTTTGTGACAGTGAAGAATCTGGATGTGATCAAGAAGGAGAACTACTATGAGGTGAACAGCAA
GTGCTACGAGGAGGCCAAGAAGCTGAAGAAGATCAGCAACCAGGCCGAGTTCATCGCCTCTTTT
TACAACAATGACCTGATCAAGATCAATGGCGAGCTGTATAGAGTGATCGGCGTGAACAATGATCT
GCTGAACAGAATCGAAGTGAATATGATCGACATCACCTACAGGGAGTATCTGGAGAACATGAATG
ATAAGAGGCCCCCTCGCATCATCAAGACCATCGCCTCTAAGACACAGAGCATCAAGAAGTACAG
CACAGACATCCTGGGGAACCTGTATGAAGTCAAGAGCAAGAAACATCCTCAGATTATCAAGAAAG
GCAGCGGCGGGAGCGGCGGGAGCGGGGGGAGCACTAATCTGAGCGACATCATTGAGAAGGAG
ACTGGGAAACAGCTGGTCATTCAGGAGTCCATCCTGATGCTGCCTGAGGAGGTGGAGGAAGTG
ATCGGCAACAAGCCAGAGTCTGACATCCTGGTGCACACCGCCTACGACGAGTCCACAGATGAGA
ATGTGATGCTGCTGACCTCTGACGCCCCCGAGTATAAGCCTTGGGCCCTGGTCATCCAGGATTC
TAACGGCGAGAATAAGATCAAGATGCTGAGCGGAGGATCCAAAAGAACCGCCGACGGCAGCGA
ATTCGAGCCCAAGAAGAAGAGGAAAGTCTAAGATCTGATAATCAACCTCTGGATTACAAAATTTG
TGAAAGATTGACTGGTATTCTTAACTATGTTGCTCCTTTTACGCTATGTGGATACGCTGCTTTAAT
GCCTTTGTATCATGCTATTGCTTCCCGTATGGCTTTCATTTTCTCCTCCTTGTATAAATCCTGGTTA
GTTCTTGCCACGGCGGAACTCATCGCCGCCTGCCTTGCCCGCTGCTGGACAGGGGCTCGGCTG
TTGGGCACTGACAATTCCGTGGTGCGACTGTGCCTTCTAGTTGCCAGCCATCTGTTGTTTGCCCC
TCCCCCGTGCCTTCCTTGACCCTGGAAGGTGCCACTCCCACTGTCCTTTCCTAATAAAATGAGGA
AATTGCATCGCATTGTCTGAGTAGGTGTCATTCTATTCTGGGGGGTGGGGTGGGGCAGGACAGC
AAGGGGGAGGATTGGGAAGACAATAGCAGGCATGCTGGGGATGCGGTGGGCTCTATGGCTCGA
GAAAAAATCTCGCCAACAAGTTGACGAGATAAACACGGCATTTTGCCTTGTTTTAGTAGATTCTG
TAATTTTCATTACAGAGTACTAAACCGAGACGCATTAATCGTCTCGGGTGTTTCGTCCTTTCCAC
AAGATATATAAAGCCAAGAAATCGAAATACTTTCAAGTTACGGTAAGCATATGATAGTCCATTTTA
AAACATAATTTTAAAACTGCAAACTACCCAAGAAATTATTACTTTCTACGTCACGTATTTTGTACTA
ATATCTTTGTGTTTACAGTCAATTAATTCTAATTATCTCTCTAACAGCCTTGTATCGTATATGCAA
ATATGAAGGAATCATGGGAAATAGGCCCTCTTCCTGCCCGACCTTGCGGCCGCAGGAACCCCTA
GTGATGGAGTTGGCCACTCCCTCTCTGCGCGCTCGCTCGCTCACTGAGGCCGGGCGACCAAAG
GTCGCCCGACGCCCGGGCTTTGCCCGGGCGGCCTCAGTGAGCGAGCGAGCGCGCAG

FIG. 26Q

AAV ITR
Cbh promoter
Bipartite NLS
AID or CDA1 or evoCDA1
Linkers
Cas9 (N- or C-terminal specified in construct title)
Npu N-terminal fragment
Npu C-terminal fragment
UGI
W3
bGH
U6-sgRNA
sgRNA spacer (Esp3I pseudospacer
in amino acid form

AID-BE3.9max AAV N-terminal, Esp3I pseudospacer (SEQ ID NO: 652)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCGATAGCCTGCTGATGAATCGGAGGAAGTTTCTGTACCAGTTCAAAAATGTGCGGTGG
GCAAAAGGGCGAAGGAGACCTACCTGTGCTATGTGGTGAAGAGGAGAGATAGCGCCACCAGC
TTCTCCCTGGACTTTGGCTACCTGAGGAACAAGAATGGCTGCCACGTGGAGCTGCTGTTCCTGC
GGTACATCTCCGACTGGGATCTGGACCCCGGCCGGTGTTATCGCGTGACCTGGTTCACATCTTG
GAGCCCTTGCTACGATTGTGCCAGGCACGTGGCCGACTTTCTGAGAGGCAACCCAAATCTGTCT
CTGCGGATCTTCACCGCCCGCCTGTATTTTTGCGAGGATCGGAAGGCCGAGCCAGAGGGCCTG
CGGCGCCTGCACAGGGCCGGCGTGCAGATCGCCATCATGACATTCAAGGACTACTTTTATTGTT
GGAACACCTTCGTGGAGAATCACGAGAGGACCTTCAAGGCCTGGGAGGGCCTGCACGAGAACT
CCGTGAGGCTGAGCAGGCAGCTGAGGAGAATCCTGCTGCCCCTGTATGAAGTGGACGACCTGC
GGGACGCCTTTAGAACTCTGGGACTGTCTGGAGGATCTAGCGGAGGATCCTCTGGCAGCGAGA
CACCAGGAACAAGCGAGTCAGCAACACCAGAGAGCAGTGGCGGCAGCAGCGGCGGCAGCGAC
AAGAAGTACAGCATCGGCCTGGCCATCGGCACCAACTCTGTGGGCTGGGCCGTGATCACCGAC
GAGTACAAGGTGCCCAGCAAGAAATTCAAGGTGCTGGGCAACACCGACCGGCACAGCATCAAG

FIG. 26R (SEQ ID NO: 652 continued)

AAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCA
CGAGAAGTACCCCACCATCTACCACCTGAGAAAGAAACTGGTGGACAGCACCGACAAGGCCGA
CCTGCGGCTGATCTATCTGGCCCTGGCCCACATGATCAAGTTCCGGGGCCACTTCCTGATCGAG
GGCGACCTGAACCCCGACAACAGCGACGTGGACAAGCTGTTCATCCAGCTGGTGCAGACCTAC
AACCAGCTGTTCGAGGAAAACCCCATCAACGCCAGCGGCGTGGACGCCAAGGCCATCCTGTCT
GCCAGACTGAGCAAGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAACTTCAAGAGCAACT
TCGACCTGGCCGAGGATGCCAAACTGCAGCTGAGCAAGGACACCTACGACGACGACCTGGACA
ACCTGCTGGCCCAGATCGGCGACCAGTACGCCGACCTGTTTCTGGCCGCCAAGAACCTGTCCG
ACGCCATCCTGCTGAGCGACATCCTGAGAGTGAACACCGAGATCACCAAGGCCCCCCTGAGCG
CCTCTATGATCAAGAGATACGACGAGCACCACCAGGACCTGACCCTGCTGAAAGCTCTCGTGCG
GCAGCAGCTGCCTGAGAAGTACAAAGAGATTTTCTTCGACCAGAGCAAGAACGGCTACGCCGGC
TACATTGACGGCGGAGCCAGCCAGGAAGAGTTCTACAAGTTCATCAAGCCCATCCTGGAAAAGA
TGGACGGCACCGAGGAACTGCTCGTGAAGCTGAACAGAGAGGACCTGCTGCGGAAGCAGCGGA
CCTTCGACAACGGCAGCATCCCCCACCAGATCCACCTGGGAGAGCTGCACGCCATTCTGCGGC
GGCAGGAAGATTTTTACCCATTCCTGAAGGACAACCGGGAAAAGATCGAGAAGATCCTGACCTT
CCGCATCCCCTACTACGTGGGCCCTCTGGCCAGGGGAAACAGCAGATTCGCCTGGATGACCAG
AAAGAGCGAGGAAACCATCACCCCCTGGAACTTCGAGGAAGTGGTGGACAAGGGCGCTTCCGC
CCAGAGCTTCATCGAGCGGATGACCAACTTCGATAAGAACCTGCCCAACGAGAAGGTGCTGCCC
AAGCACAGCCTGCTGTACGAGTACTTCACCGTGTATAACGAGCTGACCAAAGTGAAATACGTGA
CCGAGGGAATGAGAAAGCCCGCCTTCCTGAGCGGCGAGCAGAAAAAGGCCATCGTGGACCTGC
TGTTCAAGACCAACCGGAAAGTGACCGTGAAGCAGCTGAAAGAGGACTACTTCAAGAAAATCGA
GTGCCTGTCCTACGAGACAGAGATCCTGACAGTGGAGTATGGCCTGCTGCCAATCGGCAAGATC
GTGGAGAAGAGGATCGAGTGTACCGTGTACTCTGTGGATAACAATGGCAACATCTATACACAGC
CCGTGGCACAGTGGCACGATAGGGGAGAGCAGGAGGTGTTCGAGTATTGCCTGGAGGACGGCA
GCCTGATCAGGGCAACCAAGGACCACAAGTTCATGACAGTGGATGGCCAGATGCTGCCCATCGA
CGAGATTTTCGAGCGGGAGCTGGACCTGATGAGAGTGGATAACCTGCCTAATAGCGGAGGCAG
TAAAAGAACAGCAGACGGGAGTGAGTTTGAGCCCAAGAAAAAGAGAAAGGTGTAAGATCTGATA
ATCAACCTCTGGATTACAAAATTTGTGAAAGATTGACTGGTATTCTTAACTATGTTGCTCCTTTTAC
CGCTATGTGGATACGCTGCTTTAATGCCTTTGTATCATGCTATTGCTTCCCGTATGGCTTTCATTTT
CTCCTCCTTGTATAAATCCTGGTTAGTTCTTGCCACGGCGGAACTCATCGCCGCCTGCCTTGCCC
GCTGCTGGACAGGGGCTCGGCTGTTGGGCACTGACAATTCCGTGGTGCGACTGTGCCTTCTAG
TTGCCAGCCATCTGTTGTTTGCCCCTCCCCCGTGCCTTCCTTGACCCTGGAAGGTGCCACTCCC
ACTGTCCTTTCCTAATAAAATGAGGAAATTGCATCGCATTGTCTGAGTAGGTGTCATTCTATTCTG
GGGGGTGGGGTGGGGCAGGACAGCAAGGGGGAGGATTGGGAAGACAATAGCAGGCATGCTGG
GGATGCGGTGGGCTTCTATGGCTCGAGAAAAAAAGCACCGACTCGGTGCCACTTTTTCAAGTTGA
TAACGGACTAGCCTTATTTTAACTTGCTATTTCTAGCTCTAAAACCGAGACGCATTAATCGTCTCG
GGTGTTTCGTCCTTTCCACAAGATATATAAAGCCAAGAAATCGAAATACTTTCAAGTTACGGTAAG
CATATGATAGTCCATTTTAAAACATAATTTTAAAACTGCAAACTACCCAAGAAATTATTACTTTCTA
CGTCACGTATTTTGTACTAATATCTTTGTGTTTACAGTCAAATTAATTCTAATTATCTCTCTAACAG
CCTTGTATCGTATATGCAAATATGAAGGAATCATGGGAAATAGGCCCTCTTCCTGCCCGACCTTG
CGGCCGCAGGAACCCCTAGTGATGGAGTTGGCCACTCCCTCTCTGCGCGCTCGCTCGCTCACT
GAGGCCGGGCGACCAAAGGTCGCCCGACGCCCGGGCTTTGCCCGGGCGGCCTCAGTGAGCGA
GCGAGCGCGCAG

FIG. 26S

AID-BE3.9max AAV C-terminal, ESp3I pseudospacer is identical to CBE3.9max v5 AAV C-terminal, Esp3I pseudospacer (SEQ ID NO: 653)

CTGCGCGCTCGCTCGCTCACTGAGGCCGCCCGGGCAAAGCCCGGGCGTCGGGCGACCTTTGG
TCGCCCGGCCTCAGTGAGCGAGCGAGCGCGCAGAGAGGGAGTGGCCAACTCCATCACTAGGG
GTTCCTGCGGCCTCTAGATCAGGGTACCCGTTACATAACTTACGGTAAATGGCCCGCCTGGCTG
ACCGCCCAACGACCCCCGCCCATTGACGTCAATAGTAACGCCAATAGGGACTTTCCATTGACGT
CAATGGGTGGAGTATTTACGGTAAACTGCCCACTTGGCAGTACATCAAGTGTATCATATGCCAAG
TACGCCCCCTATTGACGTCAATGACGGTAAATGGCCCGCCTGGCATTGTGCCCAGTACATGACC
TTATGGGACTTTCCTACTTGGCAGTACATCTACGTATTAGTCATCGCTATTACCATGGTCGAGGT
GAGCCCCACGTTCTGCTTCACTCTCCCCATCTCCCCCCCCTCCCCACCCCCAATTTTGTATTTAT
TTATTTTTTAATTATTTTGTGCAGCGATGGGGGCGGGGGGGGGGGGGGCGCGCGCCAGGCG
GGGCGGGGCGGGGCGAGGGGCGGGGCGGGGCGAGGCGGAGAGGTGCGGCGGCAGCCAATC
AGAGCGGCGCGCTCCGAAAGTTTCCTTTTATGGCGAGGCGGCGGCGGCGGCGGCCCTATAAA
AGCGAAGCGCGCGGCGGGCGGGAGTCGCTGCGACGCTGCCTTCGCCCCGTGCCCCGCTCCGC
CGCCGCCTCGCGCCGCCCGCCCCGGCTCTGACTGACCGCGTTACTCCCACAGGTGAGCGGGC
GGGACGGCCCTTCTCCTCCGGGCTGTAATTAGCTGAGCAAGAGGTAAGGGTTTAAGGGATGGTT
GGTTGGTGGGGTATTAATGTTTAATTACCTGGAGCACCTGCCTGAAATCACTTTTTTTCAGGTTG
GACCGGTGCCACCATGAAACGGACAGCCGACGGAAGCGAGTTCGAGTCACCAAAGAAGAAGCG
GAAAGTCATCAAGATTGCTACACGGAAATACCTGGGAAAGCAGAACGTGTACGACATCGGCGTG
GAGCGGGATCACAACTTCGCCCTGAAGAATGGCTTTATCGCCAGCAATTGCTTCGACTCCGTGG
AAATCTCCGGCGTGGAAGATCGGTTCAACGCCTCCCTGGGCACATACCACGATCTGCTGAAAAT
TATCAAGGACAAGGACTTCCTGGACAATGAGGAAAACGAGGACATTCTGGAAGATATCGTGCTG
ACCCTGACACTGTTTGAGGACAGAGAGATGATCGAGGAACGGCTGAAAACCTATGCCCACCTGT
TCGACGACAAAGTGATGAAGCAGCTGAAGCGGCGGAGATACACCGGCTGGGGCAGGCTGAGCC
GGAAGCTGATCAACGGCATCCGGGACAAGCAGTCCGGCAAGACAATCCTGGATTTCCTGAAGTC
CGACGGCTTCGCCAACAGAAACTTCATGCAGCTGATCCACGACGACAGCCTGACCTTTAAAGAG
GACATCCAGAAAGCCCAGGTGTCCGGCCAGGGCGATAGCCTGCACGAGCACATTGCCAATCTG
GCCGGCAGCCCCGCCATTAAGAAGGGCATCCTGCAGACAGTGAAGGTGGTGGACGAGCTCGTG
AAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAG
CTGGGCAGCCAGATCCTGAAAGAACACCCCGTGGAAAACACCCAGCTGCAGAACGAGAAGCTG
TACCTGTACTACCTGCAGAATGGGCGGGATATGTACGTGGACCAGGAACTGGACATCAACCGGC
TGTCCGACTACGATGTGGACCATATCGTGCCTCAGAGCTTTCTGAAGGACGACTCCATCGACAA
CAAGGTGCTGACCAGAAGCGACAAGAACCGGGGCAAGAGCGACAACGTGCCCTCCGAAGAGGT
CGTGAAGAAGATGAAGAACTACTGGCGGCAGCTGCTGAACGCCAAGCTGATTACCCAGAGAAAG
TTCGACAATCTGACCAAGGCCGAGAGAGGCGGCCTGAGCGAACTGGATAAGGCCGGCTTCATC
AAGAGACAGCTGGTGGAAACCCGGCAGATCACAAAGCACGTGGCACAGATCCTGGACTCCCGG
ATGAACACTAAGTACGACGAGAATGACAAGCTGATCCGGGAAGTGAAAGTGATCACCCTGAAGT
CCAAGCTGGTGTCCGATTTCCGGAAGGATTTCCAGTTTTACAAAGTGCGCGAGATCAACAACTAC
CACCACGCCCACGACGCCTACCTGAACGCCGTCGTGGGAACCGCCCTGATCAAAAAGTACCCTA
AGCTGGAAAGCGAGTTCGTGTACGGCGACTACAAGGTGTACGACGTGCGGAAGATGATCGCCA
AGAGCGAGCAGGAAATCGGCAAGGCTACCGCCAAGTACTTCTTCTACAGCAACATCATGAACTTT
TTCAAGACCGAGATTACCCTGGCCAACGGCGAGATCCGGAAGCGGCCTCTGATCGAGACAAAC
GGCGAAACCGGGGAGATCGTGTGGGATAAGGGCCGGGATTTTGCCACCGTGCGGAAAGTGCTG
AGCATGCCCCAAGTGAATATCGTGAAAAAGACCGAGGTGCAGACAGGCGGCTTCAGCAAAGAGT
CTATCCTGCCCAAGAGGAACAGCGATAAGCTGATCGCCAGAAAGAAGGACTGGGACCCTAAGAA
GTACGGCGGCTTCGACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCATCATGGAAAGAAGC
AGCTTCGAGAAGAATCCCATCGACTTTCTGGAAGCCAAGGGCTACAAAGAAGTGAAAAAGGACC

FIG. 26T (SEQ ID NO: 653 continued)

TGATCATCAAGCTGCCTAAGTACTCCCTGTTCGAGCTGGAAAACGGCCGGAAGAGAATGCTGGC
CTCTGCCGGCGAACTGCAGAAGGGAAACGAACTGGCCCTGCCCTCCAAATATGTGAACTTCCTG
TACCTGGCCAGCCACTATGAGAAGCTGAAGGGCTCCCCCGAGGATAATGAGCAGAAACAGCTGT
TTGTGGAACAGCACAAGCACTACCTGGACGAGATCATCGAGCAGATCAGCGAGTTCTCCAAGAG
AGTGATCCTGGCCGACGCTAATCTGGACAAAGTGCTGTCCGCCTACAACAAGCACCGGGATAAG
CCCATCAGAGAGCAGGCCGAGAATATCATCCACCTGTTTACCCTGACCAATCTGGGAGCCCCTG
CCGCCTTCAAGTACTTTGACACCACCATCGACCGGAAGAGGTACACCAGCACCAAAGAGGTGCT
GGACGCCACCCTGATCCACCAGAGCATCACCGGCCTGTACGAGACACGGATCGACCTGTCTCA
GCTGGGAGGTGACAGCGGCGGGAGCGGCGGGAGCGGGGGGAGCACTAATCTGAGCGACATCA
TTGAGAAGGAGACTGGGAAACAGCTGGTCATTCAGGAGTCCATCCTGATGCTGCCTGAGGAGGT
GGAGGAAGTGATCGGCAACAAGCCAGAGTCTGACATCCTGGTGCACACCGCCTACGACGAGTC
CACAGATGAGAATGTGATGCTGCTGACCTCTGACGCCCCCGAGTATAAGCCTTGGGCCCTGGTC
ATCCAGGATTCTAACGGCGAGAATAAGATCAAGATGCTGAGCGGAGGATCCAAAAGAACCGCCG
ACGGCAGCGAATTCGAGCCCAAGAAGAAGAGGAAAGTCTAAGATCTGATAATCAACCTCTGGAT
TACAAAATTTGTGAAAGATTGACTGGTATTCTTAACTATGTTGCTCCTTTTACGCTATGTGGATAC
GCTGCTTTAATGCCTTTGTATCATGCTATTGCTTCCCGTATGGCTTTCATTTTCTCCTCCTTGTATA
AATCCTGGTTAGTTCTTGCCACGGCGGAACTCATCGCCGCCTGCCTTGCCCGCTGCTGGACAGG
GGCTCGGCTGTTGGGCACTGACAATTCCGTGGTGCGACTGTGCCTTCTAGTTGCCAGCCATCTG
TTGTTTGCCCCTCCCCCGTGCCTTCCTTGACCCTGGAAGGTGCCACTCCCACTGTCCTTTCCTAA
TAAAATGAGGAAATTGCATCGCATTGTCTGAGTAGGTGTCATTCTATTCTGGGGGGTGGGGTGG
GGCAGGACAGCAAGGGGGAGGATTGGGAAGACAATAGCAGGCATGCTGGGGATGCGGTGGGC
TCTATGGCTCGAGAAAAAAGCACCGACTCGGTGCCACTTTTTCAAGTTGATAACGGACTAGCCT
TATTTTAACTTGCTATTTCTAGCTCTAAAACCGAGACGCATTAATCGTCTCGGGTGTTTCGTCCTT
TCCACAAGATATATAAAGCCAAGAAATCGAAATACTTTCAAGTTACGGTAAGCATATGATAGTCCA
TTTTAAAACATAATTTTAAAACTGCAAACTACCCAAGAAATTATTACTTTCTACGTCACGTATTTTGT
ACTAATATCTTTGTGTTTACAGTCAAATTAATTCTAATTATCTCTCTAACAGCCTTGTATCGTATAT
GCAAATATGAAGGAATCATGGGAAATAGGCCCTCTTCCTGCCCGACCTTGCGGCCGCAGGAACC
CCTAGTGATGGAGTTGGCCACTCCCTCTCTGCGCGCTCGCTCGCTCACTGAGGCCGGGCGACC
AAAGGTCGCCCGACGCCCGGGCTTTGCCCGGGCGGCCTCAGTGAGCGAGCGAGCGCGCAG

FIG. 26U

CRISPOR Off-target candidate loci for GCTAACAGCCAGTAACATCACGG (SEQ ID NO: 655)

| offtargetSeq | mismatchPos | mismatches | cfdofftargetScore | chrom | start | end | locusDesc |
|---|---|---|---|---|---|---|---|
| GCTAATAGCCAGTAACATCACGG | .....*.............. | 1 | 0.928571429 | chr18 | 12195055 | 12195077 | exon:Npcl |
| GCTAAAAAACAATAACATCATGG | .....*.**..*........ | 4 | 0.742857143 | chr5 | 40495528 | 40495550 | intergenic:Gm23022-Rab28 |
| TCAAATAGCCAGTAAAATCAGGG | *.*..*.........*.... | 4 | 0.663265306 | chr1 | 42325147 | 42325169 | intergenic:Gm9915-2610017109Rik |
| TCTAGCAGACAATAACATCAGGG | *...*...*..*........ | 4 | 0.576 | chr13 | 37679969 | 37679991 | intergenic:Ly86-Rrebl |
| GCTAAAAGAAAGAAACATCAAGG | .....*..**..*....... | 4 | 0.477551021 | chr13 | 64286799 | 64286821 | intergenic:Cdc14b-Aaedl |
| GATAAAAGCCAAAAACATCATGG | .*...*.....**....... | 4 | 0.436363636 | chr3 | 81723658 | 81723680 | intergenic:Pdgfc-Gm22531 |

(SEQ ID NOs: 656-661)

FIG. 29B

AAV DELIVERY OF NUCLEOBASE EDITORS

RELATED APPLICATIONS

This application is a national stage filing under 35 U.S.C. § 371 of International PCT Application PCT/US2020/033873, filed May 20, 2020, which claims priority under 35 U.S.C. § 119(e) to U.S. Provisional Applications, U.S. Ser. No. 62/850,523, filed May 20, 2019, and U.S. Ser. No. 62/949,275, filed Dec. 17, 2019, each of which is incorporated herein by reference.

GOVERNMENT SUPPORT

This invention was made with government support under grant numbers UG3 TR002636, U01 AI142756, RM1 HG009490, R35 GM118062, and R01 EB022376 awarded by the National Institutes of Health. The government has certain rights in the invention.

BACKGROUND

Precise genome targeting technologies using the CRISPR/Cas9 system have recently been explored in a wide range of applications, including gene therapy. A major limitation to the application of Cas9 and Cas9-based genome-editing agents in gene therapy is the size of Cas9 (>4 kb), impeding its efficient delivery via recombinant adeno-associated virus (rAAV).

SUMMARY

Point mutations represent the majority of known pathogenic human genetic variants[1]. To enable the direct installation or correction of point mutations in living cells, base editors (or "nucleobase editors") were developed, which are engineered proteins that directly convert a target base pair to a different base pair without creating double-stranded DNA breaks[2-4]. Cytidine base editors (CBEs) such as BE4max[3, 5-7] catalyze the conversion of target C·G base pairs to T·A, while adenine base editors (ABEs) such as ABEmax[4,6] convert target A·T base pairs to G·C. While CBEs and ABEs are both widely used and work robustly in many cultured mammalian cell systems[2], the efficient delivery of base editors into live animals remains a challenge, despite promising initial studies[8-10]. A major impediment to the delivery of base editors in animals has been an inability to package base editors in adeno-associated virus (AAV), an efficient and widely used delivery agent that remains the only FDA-approved in vivo gene therapy vector[11]. The large size of the DNA encoding base editors (5.2 kb for base editors containing *S. pyogenes* Cas9, not including any guide RNA or regulatory sequences) precludes packaging in AAV, which has a genome packaging size limit of ≤5 k[12,13].

To bypass this packaging size limit and deliver base editors (or "nucleobase editors") using AAVs, a split-base editor dual AAV strategy[14,15] was devised, in which the CBE or ABE is divided into an N-terminal and C-terminal half. Each nucleobase editor half is fused to half of a fast-splicing split-intein. Following co-infection by AAV particles expressing each nucleobase editor-split intein half, protein splicing in trans reconstitutes full-length nucleobase editor. Unlike other approaches utilizing small molecules[16] or sgRNA[17] to bridge split Cas9, intein splicing removes all exogenous sequences and regenerates a native peptide bond at the split site, resulting in a single reconstituted protein identical in sequence to the unmodified nucleobase editor.

Split-intein CBEs and split-intein ABEs were developed and integrated into optimized dual AAV genomes to enable efficient base editing in somatic tissues of therapeutic relevance, including liver, heart, muscle, retina, and brain. The resulting AAVs were used to achieve base editing efficiencies at test loci for both CBEs and ABEs that, in each of these tissues, meets or exceeds therapeutically relevant editing thresholds for the treatment of some human genetic diseases at AAV dosages that are known to be well-tolerated in humans. By integrating these developments, dual AAV split-intein nucleobase editors were used to treat a mouse model of Niemann-Pick disease type C (e.g., type C1), a debilitating disease that affects the central nervous system (CNS), resulting in correction of the casual mutation in CNS tissue, and an increase in the animal's lifespan. In addition, dual AAV split-intein nucleobase editors were used to treat a mouse model of congenital deafness, resulting in correction of the casual mutation in vivo.

Accordingly, in some aspects, described herein are nucleic acid molecules, compositions, recombinant AAV (rAAV) particles, kits, and methods for delivering a Cas9 protein or a base editor (or "nucleobase editor") to cells, e.g., via rAAV vectors. Typically, a Cas9 protein or a nucleobase editor is "split" into an N-terminal portion and a C-terminal portion. The N-terminal portion or C-terminal portion of a Cas9 protein or a nucleobase editor may be fused to one member of the intein system, respectively. The resulting fusion proteins, when delivered on separate vectors (e.g., separate rAAV vectors) into one cell and co-expressed, may be joined to form a complete and functional Cas9 protein or nucleobase editor (e.g., via intein-mediated protein splicing). Further provided herein are empirical testing of regulatory elements in the delivery vectors for high expression levels of the split Cas9 protein or the nucleobase editor.

Some aspects of the present disclosure provide nucleic acid molecules encoding a N-terminal portion of a nucleobase editor fused at its C-terminus to a first intein sequence, wherein the nucleic acid molecule is operably linked to a first promoter, further comprising a nucleic acid segment encoding a guide RNA (gRNA) operably linked to a second promoter, wherein the direction of transcription of the nucleic acid segment is reversed relative to the direction of transcription of the nucleic acid molecule. Further provided are nucleic acid molecules encoding a C-terminal portion of a nucleobase editor fused at its N-terminus to a second intein sequence, wherein the nucleic acid molecule is operably linked to a third promoter, and further comprising a nucleic acid segment encoding a guide RNA (gRNA) operably linked to a fourth promoter, wherein the direction of transcription of the nucleic acid segment is reversed relative to the direction of transcription of the nucleic acid molecule.

In some embodiments, the disclosed nucleic acid molecules further comprise i) a transcriptional terminator, optionally wherein the transcriptional terminator is the transcriptional terminator from a bGH gene, hGH gene, or SV40 gene, and ii) a woodchuck hepatitis posttranscriptional regulatory element (WPRE) inserted 5' of the transcriptional terminator. In certain embodiments, the WPRE is a truncated WPRE sequence. In certain embodiments, the truncated WPRE sequence comprises W3, as first reported in Choi, J. H., et al. (2014), *Mol. Brain* 7: 17, incorporated by reference herein. In certain embodiments, the WPRE is a full-length WPRE. In certain embodiments, the first and/or third promoters comprise a Cbh promoter. In certain embodiments, the second and/or fourth promoters comprise a U6 promoter.

Other aspects of the present disclosure provide compositions comprising: (i) a first nucleotide sequence encoding a N-terminal portion of a Cas9 protein fused at its C-terminus to an intein-N; and (ii) a second nucleotide sequence encoding an intein-C fused to the N-terminus of a C-terminal portion of the Cas9 protein, wherein at least one of the first nucleotide sequence and second nucleotide sequence is operably linked to a first promoter, wherein at least one of the first nucleotide sequence and second nucleotide sequence comprises at its 3' end a gRNA nucleic acid segment encoding a guide RNA (gRNA) operably linked to a second promoter, and wherein the direction of transcription of the gRNA nucleic acid segment is reversed relative to the direction of transcription of the at least one nucleotide sequence.

In some embodiments, the Cas9 protein is a catalytically inactive Cas9 (dCas9) or a Cas9 nickase (nCas9), and wherein the first nucleotide sequence of (i) and/or the second nucleotide sequence of (ii) further comprises a nucleotide sequence encoding a nucleobase modifying enzyme fused to the N-terminus of the N-terminal portion of the Cas9 protein.

In some embodiments, the nucleobase modifying enzyme (or nucleobase modification domain) is a deaminase. In some embodiments, the deaminase is a cytosine deaminase. In some embodiments, the deaminase is an adenosine deaminase. In some embodiments, the second nucleotide sequence of (ii) further comprises a nucleotide sequence encoding a uracil glycosylase inhibitor (UGI) fused at the 3' end of the second nucleotide sequence. In some embodiments, the first nucleotide sequence of (i) further comprises a nucleotide sequence encoding a uracil glycosylase inhibitor (UGI) at the 5' end of the first nucleotide sequence. In some embodiments, the UGI comprises the amino acids sequence of SEQ ID NOs: 299-302.

In some embodiments, the first nucleotide sequence and the second nucleotide sequence are on different vectors. In some embodiments, the each of the different vectors is a genome of a recombinant adeno-associated virus (rAAV). In some embodiments, each vector is packaged in a rAAV particle. In some aspects, the present disclosure provides rAAV particles comprising a first nucleic acid molecule (e.g. encoding a N-terminal portion of a nucleobase editor or Cas9 protein fused at its C-terminus to an intein-N) as described herein. rAAV particles comprising a second nucleic acid molecule (e.g. encoding an intein-C fused to the N-terminus of a C-terminal portion of the Cas9 protein or nucleobase editor) as described herein are also provided. In some embodiments, the N-terminal portion of the Cas9 protein and the C-terminal portion of the Cas9 protein are joined together to form the Cas9 protein. The disclosed rAAV particles may comprise both a first nucleic acid molecule and second nucleic acid molecules as described herein.

In another aspect, host cells comprising the compositions described herein are provided. The disclosed cells may comprise any of the disclosed nucleic acid molecules, rAAV vectors, or rAAV particles described herein.

Some aspects of the present disclosure provide compositions comprising: (i) a first nucleotide sequence encoding a N-terminal portion of a nucleobase editor fused at its C-terminus to an intein-N; and (ii) a second nucleotide sequence encoding an intein-C fused to the N-terminus of a C-terminal portion of the nucleobase editor. Further provided herein are kits comprising the any of the compositions described herein.

In some embodiments, any of the nucleobase editors of the disclosure comprises a cytosine deaminase fused to the N-terminus of a catalytically inactive Cas9 or a Cas9 nickase. In some embodiments, the cytosine deaminase is selected from the group consisting of: APOBEC1, APOBEC3, AID, and pmCDA1. In some embodiments, the nucleobase editor further comprises a uracil glycosylase inhibitor (UGI).

Still other aspects of the present disclosure provide methods comprising contacting a cell with any of the compositions described herein, wherein the contacting results in the delivery of the first nucleotide sequence and the second nucleotide sequence into the cell, and wherein the N-terminal portion of the nucleobase editor and the C-terminal portion of the nucleobase editor are joined to form a nucleobase editor.

Still other aspects of the present disclosure provide methods comprising administering to a subject in need there of a therapeutically effective amount of any of the compositions described herein. In some embodiments, the subject has a disease or disorder (e.g. a genetic disease). In particular embodiments, the disease or condition is Niemann-Pick disease type C (NPC) disease. In other embodiments, the disease or condition is congenital deafness. In some embodiments, the disease or disorder is selected from the group consisting of: cystic fibrosis, phenylketonuria, epidermolytic hyperkeratosis (EHK), chronic obstructive pulmonary disease (COPD), Charcot-Marie-Toot disease type 4J, neuroblastoma (NB), von Willebrand disease (vWD), myotonia congenital, hereditary renal amyloidosis, dilated cardiomyopathy, hereditary lymphedema, familial Alzheimer's disease, prion disease, chronic infantile neurologic cutaneous articular syndrome (CINCA), and desmin-related myopathy (DRM).

The details of certain embodiments of the invention are set forth in the Detailed Description of Certain Embodiments, as described below. Other features, objects, and advantages of the invention will be apparent from the Definitions, Examples, Figures, and Claims.

BRIEF DESCRIPTION OF THE DRAWINGS

The accompanying drawings, which constitute a part of this Application, illustrate several embodiments of the invention and together with the description, serve to explain the principles of the invention.

FIG. 1A is a schematic representation of how the nucleobase editor is split into two portions. FIG. 1B shows that AAV-delivered split nucleobase editor can undergo protein splicing upon expression of the two halves in cells to form a complete nucleobase editor that has comparable activity to a nucleobase editor expressed as a whole. FIG. 1C shows the formation of a complete nucleobase editor from the two halves via protein splicing mediated by DnaE intein.

FIG. 3A shows the HTS reads, and FIG. 3B summarizes the base editing results.

FIG. 5A shows that the editing of arginine 158 increases overtime when the mouse astrocytes were transduced at $10^{10}$ vg, while editing of arginine 112 remained minimal. The nucleotide sequence 3' of the codon for arginine 158 sequence features a flanking NGG PAM allowing for high activity by SpCas9 (with guide sequence GAAGCGCCTGGCAGTGTACC, SEQ ID NO: 348), while the nucleotide sequence 3' of the codon for arginine 112 contains a flanking NAG PAM which does not allow for high activity (with guide sequence GACGTGCGCGGCCGCCTGGTG, SEQ ID NO: 349). FIG. 5B shows cells transduced with rAAV encoding mCherry at $10^{10}$ vg (control).

FIG. 10A is a schematic representation of the intein reconstitution strategy. Two separately encoded protein fragments fused to split-intein halves splice to reconstitute full-length protein following co-expression. FIG. 10B is a graph showing lipofection of intact BE3, split BE3 with the Npu split-intein site between E573/C574 or K637/T638, or split BE3 with the Cfa split-intein site between E573/C574 into HEK293T cells followed by high-throughput sequencing of six test loci to determine base editing efficiency. FIG. 10C is a graph comparing average editing data in FIG. 10B, normalized to BE3 levels (dotted line). BE3-normalized editing at each locus (black dots) was averaged. FIG. 10D is a graph showing "BEmax" optimization of nuclear localization signals and codon usage increases editing efficiency at six standard loci. BE3.9max and BE4max show comparable editing efficiencies. FIG. 10E is a graph comparing average editing data in FIG. 10D, normalized to BE4 levels (dotted line). FIG. 10F is a graph showing lipofection of ABEmax (left bar) or Npu-split E573/C574 ABEmax (right bar) into NIH 3T3 cells for generation of a split-intein adenosine nucleobase editor. In FIG. 10B and FIG. 10D, dots represent values and bars represent mean+SD of n=3 independent biological replicates. Dots in FIG. 10C and FIG. 10E represent locus averages.

FIG. 11A contains images showing GFP expression three weeks after injection of $1\times10^{11}$ vg of GFP-NLS-bGH, GFP-NLS-W3-bGH, or GFP-NLS-WPRE-bGH into six-week-old C57BL/6 mice. Representative images of horizontal brain slices show hippocampus and neocortex. Top panels show DAPI and EGFP signals overlaid; bottom panels show EGFP signal only. The scale bar represents 500 μm. FIG. 11B is a graph showing transcriptional regulatory element optimization. Total GFP signal measured by ImageJ from mice injected as described in FIG. 11A. See methods for a detailed description of imaging and analysis procedures. FIG. 11C is a graph showing the number of GFP-positive cells per horizontal brain slice from the mice described in FIG. 11A. GFP-positive cells were identified by ilastik/CellProfiler as described in the image analysis section of the Methods of Example 3. FIG. 11D is a schematic of v3, v4, and v5 AAV variants. Arrows indicate direction of U6 promoter transcription. The CBE3.9 coding sequence consists of rAPOBEC1, spCas9 D10A nickase, and UGI. Small white boxes in v3 are non-essential backbone sequences removed in v4 and v5 AAV. See FIG. 17 for the schematic of v5 AAV-ABEmax. FIG. 11E is a graph showing cytosine base editing efficiencies in NIH 3T3 cells following a 14-day incubation with v3 AAV, v4 AAV, and v5 AAV. Dots and bars in FIG. 11B and FIG. 11C represent individual replicates and mean+SD of n=2-3 animals, 3-6 slices per animal. Darkened circles and error bars in FIG. 11E represent mean±SD. Dots in FIG. 11E represent values for independent biological replicates (n=3-4).

FIG. 12A is a schematic showing six-week-old C57BL/6 mice were treated by retro-orbital injection of $2\times10^{12}$ vg total of v5 AAV9. After 4 weeks, organs were harvested and genomic DNA of unsorted cells was sequenced. FIG. 12B is a graph showing cytosine base editing by v5 AAV CBE3.9max in the indicated organs. FIG. 12C is a graph showing adenine base editing by v5 AAV ABEmax in the indicated organs. FIG. 12D is a graph comparing adenine base editing from v5 AAV-mediated ABEmax (grey bars) and from trans-mRNA splicing (white bars). Bars represent mean+SD of n=3 animals.

FIG. 13A is a schematic of P0 intraventricular injections. P0 C57BL/6 mice were co-injected with $4\times10^{10}$ vg total of v5 CBE3.9max or ABEmax AAV targeting DNMT1 and $1\times10^{10}$ vg Cbh-KASH-GFP. Sorting for GFP-positive cells enriches for triply transduced cells. Tissue was harvested 3-4 weeks after injection, and cortex and cerebellum were separated. Cortical tissue comprises neocortex and hippocampus. For each tissue, nuclei were dissociated and analyzed as unsorted (all nuclei) or GFP-positive populations for DNA sequencing. FIG. 13B is a graph showing percent GFP-positive nuclei measured by flow cytometry following P0 injection. FIG. 13C is a graph showing cytosine base editing efficiency following P0 v5 CBE3.9max AAV injection in cortex and cerebellum at DNMT1 for unsorted nuclei (left bars) and GFP-positive nuclei (right bars). FIG. 13D is a graph showing adenosine base editing efficiency following P0 v5 CBE3.9max AAV9 injection in cortex and cerebellum at DNMT1 for unsorted nuclei (left bar) and GFP-positive nuclei (right bar). FIG.

13E is a schematic of retro-orbital injections. Brains from 9-week-old C57BL/6 mice were harvested 4 weeks after injection with $4\times10^{12}$ vg total v5 CBE3.9max or ABEmax AAV targeting DNMT1 and $2\times10^{11}$ vg KASH-GFP AAV, then processed and analyzed as described in FIG. 13A. FIG. 13F is a graph showing cytosine base editing in unsorted (left bar) and GFP-positive (right bar) cortical and cerebellar cells following the procedure described in FIG. 13A. Bars represent mean+SD. Black dots represent individual animals (n=3-4).

FIG. 14A is a schematic of sub-retinal injections. Two-week-old Rho-Cre; Ai9 mice were treated by sub-retinal injection of $1\times10^{9}$ to $1\times10^{10}$ vg total of v5 CBE3.9max or v5 ABEmax AAV targeting DNMT1. For each group, at least three eyes were injected. Three weeks after injection, injected retinas were sorted into GFP-negative/tdTomato-positive (rod photoreceptors not transduced with GFP), tdTomato-positive/GFP-positive (transduced rods), GFP-positive/tdTomato-negative (marker transduced non-rod), and double-negative populations (unmarked non-rods, not shown). FIG. 14B is a graph showing the percentage of GFP transduced rod photoreceptors or non-rod retinal cells followed by subretinal injection of AAV mix of PHP.B-CBE, Anc80-CBE and Anc80-ABE AAV, respectively. The dose of AAV-GFP is $2\times10^{9}$ vg for PHP.B-CBE mix, $3.3\times10^{8}$ vg for Anc80-CBE mix and $4.5\times10^{8}$ vg for Anc80-ABE mix. FIG. 14C contains images showing the expression of tdTomato in the rod photoreceptor cells of Rho-Cre; Ai9 mice (left panel). Retinal transduction of PHP.B-GFP (middle panel) or Anc80-GFP (right panel) at $5\times10^{9}$ vg. Scale bar=20 μm. FIG. 14D is a graph showing cytosine base editing by v5 CBE3.9max PHP.B AAV in injected retinas. Editing percentage in all rods was inferred as ((editing % in GFP transduced rods)*(number of transduced rods)+(editing % in unmarked rods)*(number of unmarked rods))/total rods. This calculation was repeated for non-rods. FIG. 14E is a graph showing cytosine base editing by v5 CBE3.9max Anc80 AAV in photoreceptors and other retinal cells. Editing efficiencies in all rods and all non-rods were inferred as described for FIG. 14B. FIG. 14F is a graph showing adenine base editing by v5 ABEmax Anc80 AAV in photoreceptors. All GFP-positive cells were pooled in this experiment, resulting in a single GFP-positive population containing tdTomato-positive and tdTomato-negative cells (hashed bar). Bars represent mean+SD. Black dots represent individual eyes (n=3-4).

FIG. 15A is a schematic of the NPC1 locus highlighting the mutation in exon 21, the protospacer and PAM sequence targeted, and the desired CBE-mediated reversion of I1061T. The scale bar represents 5 kilobases. FIG. 15B is a Kaplan-Meier plot of homozygous $NPC1^{I1061T}$ mice injected with $4\times10^{10}$ vg total of v5 CBE3.9max AAV9 targeting $NPC1^{I1061T}$ (blue; n=7), untreated homozygous $NPC1^{I1061T}$ mice (red; n=12), and $NPC1^{I1061T}$ heterozygous animals (black; n=14). FIG. 15C is a Kaplan-Meier plot of $NPC1^{I1061T}$ mice injected with $1\times10^{11}$ vg total v5 CBE3.9max AAV9 targeting $NPC1^{I1061T}$ (blue; n=5), with data from the other two cohorts replotted from FIG. 15B. FIG. 15D is a graph showing cortical and cerebellar base editing in P0 animals injected with v5 AAV9 targeting $NPC1^{I1061T}$ Lighter bars report editing in unsorted or GFP-positive cells following injection of n=3 mice of $4\times10^{10}$ vg ($2\times10^{10}$ vg of each split nucleobase editor half); darker bars correspond to editing following injection of $1\times10^{11}$ vg ($5\times10^{10}$ vg of each split nucleobase editor half). FIG. 15E is a graph showing base editing to the precisely corrected wild-type allele shown in FIG. 15A. Lighter bars indicate the frequency of alleles that are corrected to the wild-type sequence; darker bars replotted from FIG. 15D indicate total C·G-to-T·A editing in the T1061 codon ("ACA") in FIG. 15A. FIG. 15F is a graph showing precisely corrected (wild-type) alleles as a percentage of all edited alleles. In FIG. 15B and FIG. 15C, tick marks indicate animal deaths. Bars represent mean+SD. Dots represent individual animals (n=3-5). FIG. 15G shows immunofluorescent measurements of calbindin and DAPI staining in midline saggital cerebellar slices from P98-P105 mice. Calbindin is indicated as the darker stain, and DAPI is indicated as the lighter stain. Images were taken using an Eclipse Ti microscope (Nikon).Wild-type, n=3 mice, 15 images; $NPC1^{I1061T}$ untreated, n=2 mice, 6 images; $NpC1^{I1061T}$ AAV-CBE, n=2 mice, 10 images. Untreated vs. treated, two-sided t-test, p=0.0005. FIG. 15H shows immunofluorescent measurements of CD68+ tissue area. Images are representative CD68-stained midline saggital cerebellar slices from P98-P105 mice. EGFP-KASH labeled cells are indicated with the (^) symbol, CD68+ labeled cells are indicated with the (>) symbol, and DRAQ5 signal is indicated with the (*) symbol. The untreated mice were uninjected and did not express GFP. In the quantification of CD68+ tissue area, each point represents the average per mouse. Wild-type, n=3 mice, 15 images; $Npc1^{I1061T}$ untreated, n=2 mice, 6 images; $NPC1^{I1061T}$ AAV-CBE, n=2 mice, 10 images. Untreated vs. treated, two-sided t-test, p=0.0005. The middle subpanel reports base editing to the precisely corrected wild-type allele shown in FIG. 15A from the $1\times10^{11}$ vg injections. Lighter bars indicate the frequency of alleles that are corrected to the wild-type sequence; replotted darker bars indicate total C·G-to-T·A editing of the T1061 codon ("ACA") in FIG. 15A. The right subpanel shows precisely corrected (wild-type) alleles as a percentage of all edited alleles in mice injected with $1\times10^{11}$ vg. In FIG. 15B, tick marks indicate animal deaths. In all other panels, bars represent mean+SD. Dots represent individual mice. Scale bars represent 200 μm. Statistical tests for immunofluorescence are two-sided t-tests without multiple comparison corrections.

FIG. 16A contains graphs showing editing performance in HEK293T cells of seven split *S. aureus* nucleobase editors with intein insertions between K534/C535, Y537/S538, Q501/T502, N484/S485, L431/S432, R453/S454, or Q457/S458. For each of the six endogenous genomic test sites, 16 bases of the protospacer, numbered with the PAM starting at position 21 are shown on the X axis. Unsplit *S. aureus* BE3 (saBE3) data are shown as black stars; seven split-intein CBEs are shown as shaded circles. Note that ABOBEC1 exhibits an anti-GpC preference. FIG. 16B contains bar graphs of editing efficiency at the most highly edited C for each site. Shading patterns correspond to the shading patterns of the circles shown in FIG. 16A. FIG. 16C is a graph showing the average editing across the six genomic sites, normalized to unsplit saBE3 editing (dotted line). FIG. 16D shows a sample Western blot of *S. pyogenes* nucleobase editor expression (BE3.9max and Npu-BE3.9max) in HEK293T cells. The lanes to the left of the ladder have been stained against FLAG. The lanes to the right are the same samples stained against HA. The FLAG-stained lanes are co-stained against GAPDH loading control. Untagged BE3.9max is shown in the first lane; other samples are tagged as indicated. This representative blot is one of three biological replicates. FIGS. 16E-16F show editing at the HEK3 locus by the tagged editor constructs. The bars in FIG. 16E correspond to the lanes shown on the Western blot; the bars in FIG. 16F show additional conditions measuring the effect of tagging on editing efficiency. NpuC1A constructs are split-intein constructs containing the inactivating Npu N-terminal C1A mutation. In FIG. 16A, and FIGS. 16E-16F, dots are mean+SD of n=3 independent biological replicates. In FIG. 16B and FIG. 16C, bars represent mean+SD. In FIG. 16B, dots represent values from independent biological replicates (n=3). Dots in FIG. 16C represent average editing at each of n=6 tested sites.

FIG. 18A is a graph showing cytosine base editing by v5 AAV CBE3.9max in organs poorly transduced by AAV9. The dotted line indicates the detection threshold of 0.1% editing. FIG. 18B is a graph comparing adenine base editing from v5 AAV-mediated ABEmax (grey bars, right) and from trans-mRNA splicing (white bars, left). Bars represent mean+SD of n=3 animals. FIG. 18C shows a comparison of cytosine base editing mediated by v5 AAV-SaBE3.9max compared to previously-reported constructs, which were modified to replace the liver-specific P3 promoter with Cbh and to replace the Pah sgRNA with PCKS9-targeting sgRNA. Bars to the left of the dotted line report editing in livers of mice injected retro-orbitally with $1\times10^{11}$ vg total; bars to the right report a dose of $1\times10^{12}$ vg total. Bars represent mean+SD of n=3 mice.

FIG. 19A is a schematic of P0 intraventricular injections. P0 L7-GFP mice were injected with $5\times10^{10}$ vg of PHP.B Cbh-mCherry-NLS. Brains were prepared for imaging following a three-week incubation. Visible cerebellar cells fall into three categories: GFP-positive, mCherry-negative=untransduced Purkinje cells; GFP-negative, mCherry-positive=transduced non-Purkinje cells; and GFP-positive, mCherry-positive=transduced Purkinje cells. The overlap of EGFP and mCherry, which are shared in light grey and dark grey, respectively, produces white nuclei in transduced Purkinje cells. FIG. 19B contains sample cerebellar images from horizontally sliced hemispheres of injected L7-GFP mice. Left panel shows EGFP and mCherry signals overlaid; center and left panels respectively show EGFP and mCherry only. The scale bar represents 500 μm.

FIG. 20A is a graph showing cytosine base editing by v5 CBE3.9max PHP.B AAV in photoreceptors and other retinal cells. Diagonal-striped bars represent data re-analyzed after discarding indel-containing reads. Editing percentage was then calculated by dividing the number of T·A-containing reads by the original total read number. Removal of indel-containing reads was manually verified. The inferred editing percentages were calculated as in FIGS. 14A-14F: the editing percentage in all rods was inferred as ((editing % in transduced rods)*(number of transduced rods)+(editing % in unmarked rods)*(number of unmarked rods))/total rods. This calculation was repeated for non-rods. FIG. 20B is a graph showing cytosine base editing by v5 CBE3.9max Anc80 AAV in photoreceptors and other retinal cells. Indel removal was performed and editing efficiencies in all rods and all non-rods were inferred as described for FIG. 20A.Bars represent mean+SD. Black dots represent individual eyes (n=3).

FIG. 21A is a graph showing editing in $NPC1^{I1061T/+}$ mice injected at P0 with $1\times10^{11}$ vg v5 CBE3.9max AAV9. The shaded area and dotted line indicate that in unedited heterozygous animals, 50% of HTS reads are expected to contain a T·A. Brains were harvested and sequenced at P29 after sorting into unsorted (left bar) or GFP-positive (right bar) cells. The darker bars represent unsorted and GFP-positive cells harvested at P110. FIG. 21B is a graph showing the percent of edited cells inferred from the percent of T·A-containing reads. The percent of edited cells was calculated as 2*(% T·A–50). Bars represent mean+SD. Dots represent individual animals (n=3). FIG. 21C shows the cerebellar Cas9/EGFP staining in a P110 mouse injected at P0 with v5 AAV-CBE and GFP-KASH. Merged images show EGFP in darker shading and Cas9 in lighter shading. The Cas9 antibody is a mouse monoclonal antibody which binds a motif in the C-terminal half of the split editor. The dashed white rectangle indicates the zoomed-in area depicted in the single-channel images. Greyscale images are as labeled. FIG. 21D shows cortical Cas9/EGFP staining in a P110 mouse injected at P0 with v5 AAV-CBE and GFP-KASH. Merged images show EGFP as the darker label and Cas9 as the lighter label. Images in FIG. 21C and FIG. 21D are representative of n=2 mice. The dashed white rectangle indicates the zoomed-in area depicted in the single-channel images. In FIG. 21A and FIG. 21B, bars represent mean+SD. Black dots represent individual mice.

FIGS. 22A-22C are a tables showing base editing efficiency, indel frequency, and base editing:indel ratio for all in vivo experiments at the DNMT1 locus. All in vivo intein-split experiments were performed with v5 AAV and are listed according to the figure in which they appear. The percentage of reads with C·G to T·A editing (CBE3.9max) or A·T to G·C editing (ABEmax) was divided by the percentage of reads containing indels to generate the base editing: indel ratio. All analyses of HTS data were performed by CRISPResso2 as described in the Methods section of Example 3. Crispresso2 is a public software that provides analyses of genome editing outcomes from deep sequencing data. See Clement et al., *Nat Biotechnol.* 2019 March; 37(3):224-226, herein incorporated by reference. All values represent mean±SD.

FIGS. 25A-25B are tables containing primers used to generate sgRNA sequences and amplify genomic DNA. All sgRNA forward primers have 5'-CACC overhangs, and all reverse primers have 5'-AAAC overhangs to generate overhangs for efficient ligation. Primers for gDNA amplification contain bolded 5' Illumina adapter sequences and 3' gene-specific sequences (no special formatting).

FIGS. 26A-26U show the recombinant AAV vector construct nucleotide sequences encoding the CBE3.9max, ABEmax, and AID-BE3.9max nucleobase editors evaluated in the Examples. All constructs cloned in the px601 backbone (F. Zhang) modified to correct an 11-bp deletion in the left ITR. Pseudospacer-containing backbones were cut with Esp3I or BsmBI endonucleases. Primers listed in FIGS. 25A-25B were annealed and ligated with standard molecular biology techniques. Annotations are coded as described in the figure. The U6-sgRNA cassette was omitted from the ABEmax N-terminal constructs to keep the total construct size under the packaging limit.

FIG. 28A shows representative single-channel images of cerebellar slices stained against EGFP, CD68, and DNA in greyscale. EGFP labels cells transduced with GFP-KASH AAV transduction marker. CD68 labels reactive microglia, and DRAQ5 labels DNA. The $NPC1^{I1061T}$ animal in this case was not transduced. Multi-channel images from FIGS. 15A-15H are reproduced for clarity. The dotted white rectangle in the rightmost (treated) column highlights one area that is $GFP^+/CD68^-$. Scale bar is 200 μm. FIG. 28B shows, CD68+ cells per $mm^2$ in wild-type, treated, and untreated mice. Bars represent mean+SD. Black dots represent individual mice. For (a) and (b), n=3 wild-type; n=2 treated; n=2 untreated mice).

FIGS. 29A-29D show an off-target analysis of NPC1-targeting sgRNA. FIG. 29A shows the results of CIRCLE-seq using the NPC1-targeting sgRNA and Cas9 to cut gDNA harvested from untreated $NPC1^{I1061T}$ mouse liver. Note that off-target candidate sequences are aligned to the wild-type C57BL/6 genome; the wildtype NPC1 allele on line 2 is not present in the assay. FIG. 29B shows a CRISPOR off-target analysis off the six sites with the highest predicted Cas9 activity as determined by CFD score, including the on-target site, in descending order. Off-target guide sequences are shown in the left-most column. FIG. 29C shows an amplicon sequencing of the three CIRCLE-seq candidate loci from treated, sorted mouse cortical and cerebellar samples shown in FIG. 15F. FIG. 29D shows amplicon sequencing of the top five CRISPOR predicted Cas9 off-target sites from treated, sorted mouse cortical and cerebellar samples shown in FIG. 15F. In FIGS. 29C-29D, individual cytosines in the protospacer are arrayed on the x-axis, with base 1 the farthest from the PAM and base 20 PAM adjacent, as depicted in FIG. 29A. Light grey bars indicate cerebellar samples; dark grey bars indicate cortical samples. The dotted line indicates the detection threshold of 0.1% editing. Bars represent mean+SD. Black dots represent individual mice (n=4 mice for cerebellar samples; n=5 mice for cortical samples).

FIG. 30A is a schematic of the Tmc1 locus highlighting the c.A545G mutation (red), silent bystander bases, and three candidate guide RNAs that position the target C (directly below "Y/C") at different protospacer positions ($C_8$, $C_7$, $C_{10}$) and the use of different PAMs (AGG, GGA and TGA). FIG. 30B shows base editing efficiencies for the four CBE-P2A-GFP variants tested with sgRNA1 (where the four CBEs are APOBEC1-BE4max, CDA1-BE4max, evoCDA1-BE4max, or AID-BE4max). Base editing values (blue bars) reflect the correction of the Baringo mutation to the wild-type TMC1 protein coding sequence, with no other non-silent changes or indels. Three days following nucleofection into Baringo MEF cells, GFP positive (GFP+) cells were sorted and genomic DNA was characterized by high-throughput sequencing. FIG. 30C shows base editing efficiencies for three different guide RNAs tested with AID-BE4max variants: AID-BE4max+sgRNA1, AID-VRQR-BE4max+sgRNA2, or AID-VRQR-BE4max+sgRNA3. Three days following nucleofection of these plasmids into Baringo MEF cells, GFP-positive cells were sorted and sequenced by HTS. FIG. 30D shows base editing efficiencies in Baringo MEF cells following a 14-day incubation with dual AAV encoding AID-BE3.9max+sgRNA1 at high (N terminal: $6.1\times10^8$ vg, C terminal: $8.3\times10^8$ vg) and low ($3.1\times10^7$ vg, C terminal: $4.2\times10^7$ vg) doses. Dots, shaded bars, and error bars represent individual biological replicates, mean values, and SEM, respectively (n=3-5).

FIG. 31A shows the ten most abundant genomic DNA cleavage products (which include the on-target site and nine potential off-target sequences) from Cas9 nuclease+sgRNA1 as identified in vitro by CIRCLE-seq, aligned to the on-target Tmc1 sequence. FIG. 31B shows an editing analysis of the nine candidate off-target sites identified by CIRCLE-seq in MEF cells treated with dual AAV encoding AID-BE3.9max+sgRNA1. The on-target locus, plus the top nine off-target sites identified by CIRCLE-seq, were sequenced by HTS. Dots and bars represent biological replicates and mean±SEM (n=3). FIG. 31C shows the efficiency of AID-BE3.9max+sgRNA1-mediated editing in treated Baringo ($Tmc1^{Y182C/Y182C}$; $Tmc2^{+/+}$) mice. Mouse inner ears were injected at P1 with 1 μL ($3.1\times10^9$ vg of each AAV) dual AAV encoding AID-BE3.9max+sgRNA1. After 14 days, cochleas were microdissected into base, mid, and apex samples. Genomic DNA was extracted from each sample and sequenced by HTS. Each dot represents the efficiency of generating Tmc1 alleles with wild-type TMC1 protein sequence and no other non-silent mutations or indels, averaging all samples sequenced from one injected cochlea. To obtain Tmc1 mRNA from the cochlea, the cochlea was extracted at P30, isolated RNA, reverse transcribed into cDNA, and analyzed by HTS. Each dot represents the mRNA from one injected cochlea. FIGS. 31D-31F show representative scanning electron microscopy (SEM) images at the apical turn of OHCs and IHCs of wild-type ($Tmc1^{+/+}$; $Tmc2^{+/+}$) mice (FIG. 31D), untreated Baringo ($Tmc1^{Y182C/Y182C}$; $Tmc2^{+/+}$) mice (FIG. 31E), and Baringo mice treated with dual AAV encoding AID-BE3.9max+sgRNA1 (FIG. 31F). The organ of Corti samples were imaged by SEM at 4 weeks. Scale bar, 10 μm.

FIG. 32A shows confocal images of mid-turn cochlear sections excised from P5 Tmc1$^{Y182C/Y182C}$; Tmc$^{2\Delta/\Delta}$ mouse cochleas. A representative untreated mouse (top panel) or a representative mouse treated with 1 μL ($3.1\times10^9$ vg of each AAV) of dual AAV encoding AID-BE3.9max+sgRNA1 (bottom panel) are shown. The tissue was cultured for 9-13 days and treated with 5 μM FM1-43 for 10 seconds followed by three full bath exchanges to wash out excess dye. The tissue was mounted and imaged for FM1-43 uptake (light shading) in IHCs and OHCs. All images are 500×150 μm. Scale bar, 50 μm. FIG. 32B is a graph showing the quantification of FM1-43-positive IHCs from untreated and treated mice represented as mean±SD (n=3-4 different mice in each group). FIG. 32C is a graph showing representative families of sensory transduction currents evoked by mechanical displacement of hair bundles recorded from apical IHCs of untreated Tmc1$^{Y182C/Y182C}$; Tmc2$^{\Delta/\Delta}$ mice at P8 (untreated), from Tmc1$^{Y182C/Y182C}$; Tmc2$^{\Delta/\Delta}$ mice treated with dual AAV encoding AID-BE3.9max+sgRNA1 at P14 and P18 and from wild-type Tmc1$^{+/+}$; Tmc2$^{+/+}$ mice at P14-16. Horizontal lines and error bars reflect mean values and SD of 3-4 independent mice and 4-8 hair cells (indicated on top of x-axis), with each dot representing one IHC.

FIG. 33A shows representative sets of ABR waveforms recorded in response to 5.6-kHz tone bursts of varying sound intensity for untreated wild-type mice (left) and wild-type mice treated with dual AAV encoding AID-BE3.9max+sgRNA1 (right). FIG. 33B shows the same as FIG. 33A, but with untreated Baringo mice (left) and Baringo mice treated with 1 μL ($3.1\times10^9$ vg of each AAV) dual AAV encoding AID-BE3.9max+sgRNA1 (right). FIG. 33C shows the mean ABR responses for all four groups (untreated and treated, Baringo and wild-type mice) across all tested frequencies. Untreated Baringo mice (black, n=10) are profoundly deaf, with no detectable ABR threshold (>110 dB, indicated by the upward arrows). Among the treated Baringo mice (n=15) injected with dual AAV encoding AID-BE3.9max+sgRNA1, nine showed ABR response improvements of up to >50 dB (series of overlapping lines associated with "n=9"), while six did not show any rescue (grey line, n=6). Untreated wild-type mice (darker line, n=6) and wild-type mice injected with dual AAV encoding AID BE3.9max+sgRNA1 (lighter line, n=4) show similar ABR thresholds. FIG. 33D shows that the same mice in FIG. 33C were subjected to DPOAE testing. Untreated (black line, n=10) and treated Baringo mice both showed no DPOAE responses under the tested conditions (up to 80 dB). Untreated wild-type mice (darker line, n=6) and wild-type mice injected with dual AAV encoding AID-BE3.9max+ sgRNA1 (lighter line, n=4) exhibited normal DPOAE thresholds. All recordings were done at P30. Values and error bars reflect mean±SD for the numbers of mice specified above.

FIG. 35A shows low magnification, and FIG. 35B shows high magnification images of the entire apical and basal portions of the cochlea of a wild-type mouse injected at P1 with 1 μL of Anc80-Cbh-GFP AAV. The cochlea was harvested at P10, stained with Alexa555-phalloidin, and imaged for Alexa555 and GFP. Scale bar, 50 μm. FIG. 35C shows the number of hair cells are calculated by phalloidin-positive HCs and number of GFP+ HCs are counted. Values and error bars reflect individual data points and mean±SD from three samples from n=3 different mice in each group.

FIG. 37A shows representative current traces from IHCs of a Tmc1$^{Y182C/Y182C}$; Tmc2$^{+/+}$ mouse (P7) and Tmc1$^{Y182C/Y182C}$; Tmc2$^{\Delta/\Delta}$ mouse (P6) are shown. FIG. 37B shows that cellular recordings were obtained from the basal and mid-apical regions of IHCs or OHCs at different time points (P6-P27). Horizontal lines and error bars reflect mean values and SD of 3-4 independent mice and 2-8 hair cells (indicated on top of x-axis), with each dot representing one OHC or IHC.

FIG. 38A shows representative, low-magnification images of whole-mount apical and basal turns from Tmc1$^{Y182C/Y182C}$; Tmc2$^{+/+}$ mice treated with AAV-AID-BE3.9max+sgRNA1 and Tmc1$^{Y182C/Y182C}$; Tmc2$^{+/+}$ mice without treatment. Samples were stained with Myo7A (lighter shading) to label hair cells. FIG. 38B shows high-magnification images of the same cochleas boxed in FIG. 38A. FIG. 38C is a graph showing the quantification of the number of Myo7A positive IHCs and OHCs from entire cochleas of three untreated Tmc1$^{Y182C/Y182C}$; Tmc2$^{+/+}$ and four Tmc1$^{Y182C/Y182C}$; Tmc2$^{+/+}$ mice treated with dual AAV-AID-BE3.9max+sgRNA1 at P1. Dots and bars represent biological replicates and mean±SD.

DEFINITIONS

Figure 1A:
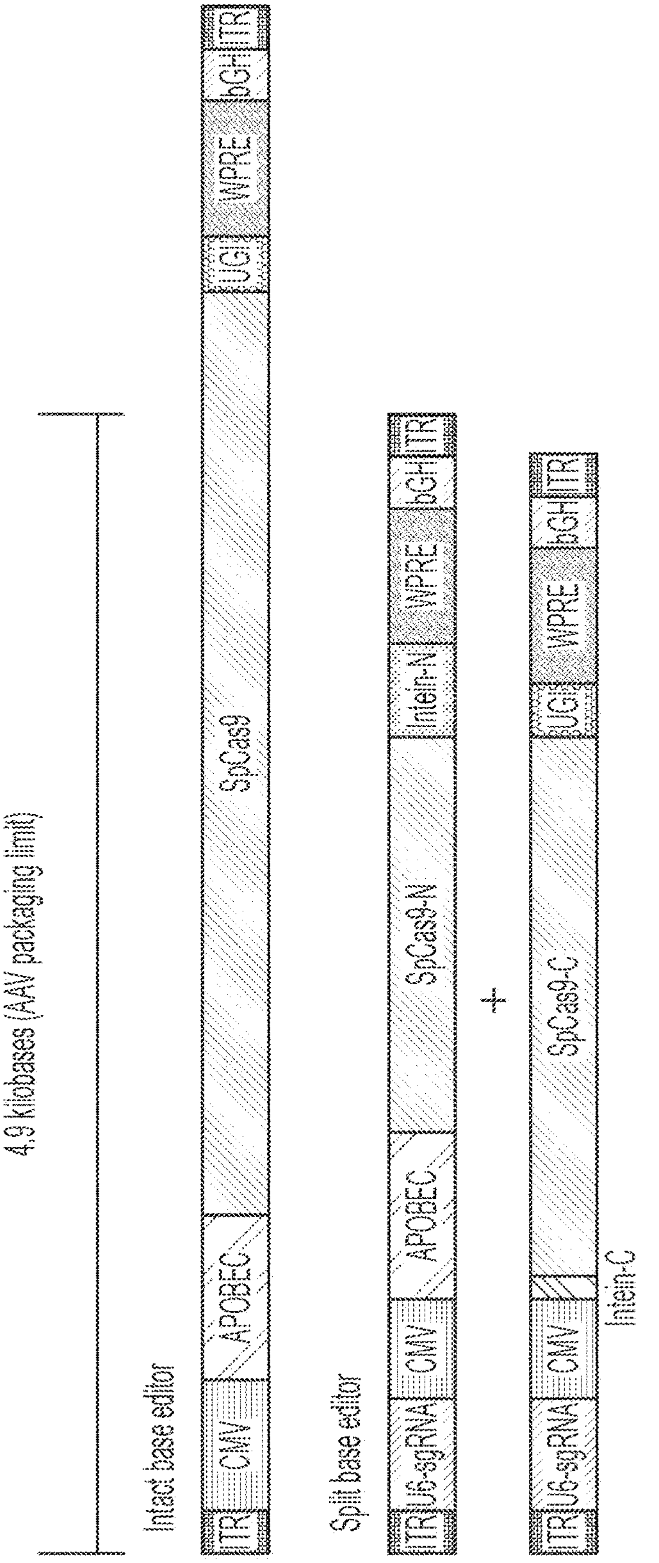
FIGS. 1A-1C are graphs showing a "split nucleobase editor" for delivery into cells using recombinant adeno associated virus (rAAV) vectors.

As used herein and in the claims, the singular forms "a," "an," and "the" include the singular and the plural reference unless the context clearly indicates otherwise. Thus, for example, a reference to "an agent" includes a single agent and a plurality of such agents.

An "adeno-associated virus" or "AAV" is a virus which infects humans and some other primate species. The wild-type AAV genome is a single-stranded deoxyribonucleic acid (ssDNA), either positive- or negative-sensed. The genome comprises two inverted terminal repeats (ITRs), one at each end of the DNA strand, and two open reading frames (ORFs): rep and cap between the ITRs. The rep ORF comprises four overlapping genes encoding Rep proteins required for the AAV life cycle. The cap ORF comprises overlapping genes encoding capsid proteins: VP1, VP2 and VP3, which interact together to form the viral capsid. VP1, VP2 and VP3 are translated from one mRNA transcript, which can be spliced in two different manners: either a longer or shorter intron can be excised resulting in the formation of two isoforms of mRNAs: a ~2.3 kb- and a ~2.6 kb-long mRNA isoform. The capsid forms a supramolecular assembly of approximately 60 individual capsid protein subunits into a non-enveloped, T-1 icosahedral lattice capable of protecting the AAV genome. The mature capsid is composed of VP1, VP2, and VP3 (molecular masses of approximately 87, 73, and 62 kDa respectively) in a ratio of about 1:1:10.

rAAV particles may comprise a nucleic acid vector (e.g., a recombinant genome), which may comprise at a minimum: (a) one or more heterologous nucleic acid regions comprising a sequence encoding a protein or polypeptide of interest (e.g., a split Cas9 or split nucleobase) or an RNA of interest (e.g., a gRNA), or one or more nucleic acid regions comprising a sequence encoding a Rep protein; and (b) one or more regions comprising inverted terminal repeat (ITR) sequences (e.g., wild-type ITR sequences or engineered ITR sequences) flanking the one or more nucleic acid regions (e.g., heterologous nucleic acid regions). In some embodiments, the nucleic acid vector is between 4 kb and 5 kb in size (e.g., 4.2 to 4.7 kb in size). In some embodiments, the nucleic acid vector further comprises a region encoding a Rep protein. In some embodiments, the nucleic acid vector is circular. In some embodiments, the nucleic acid vector is single-stranded. In some embodiments, the nucleic acid vector is double-stranded. In some embodiments, a double-stranded nucleic acid vector may be, for example, a self-complimentary vector that contains a region of the nucleic acid vector that is complementary to another region of the nucleic acid vector, initiating the formation of the double-strandedness of the nucleic acid vector.

As used herein, the term "adenosine deaminase" or "adenosine deaminase domain" refers to a protein or enzyme that catalyzes a deamination reaction of an adenosine (or adenine). The terms are used interchangeably. In certain embodiments, the disclosure provides nucleobase editor fusion proteins comprising one or more adenosine deaminase domains. For instance, an adenosine deaminase domain may comprise a heterodimer of a first adenosine deaminase and a second deaminase domain, connected by a linker. Adenosine deaminases (e.g., engineered adenosine deaminases or evolved adenosine deaminases) provided herein may be enzymes that convert adenine (A) to inosine (I) in DNA or RNA. Such adenosine deaminase can lead to an A:T to G:C base pair conversion. In some embodiments, the deaminase is a variant of a naturally-occurring deaminase from an organism. In some embodiments, the deaminase does not occur in nature. For example, in some embodiments, the deaminase is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

In some embodiments, the adenosine deaminase is derived from a bacterium, such as, *E. coli, S. aureus, S. typhi, S. putrefaciens, H. influenzae*, or *C. crescentus*. In some embodiments, the adenosine deaminase is a TadA deaminase. In some embodiments, the TadA deaminase is an *E. coli* TadA deaminase (ecTadA). In some embodiments, the TadA deaminase is a truncated *E. coli* TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. Reference is made to U.S. Patent Publication No. 2018/0073012, published Mar. 15, 2018, which is incorporated herein by reference.

In genetics, the "antisense" strand of a segment within double-stranded DNA is the template strand, and which is considered to run in the 3' to 5' orientation. By contrast, the "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

"Base editing" refers to genome editing technology that involves the conversion of a specific nucleic acid base into another at a targeted genomic locus. In certain embodiments, this can be achieved without requiring double-stranded DNA breaks (DSB), or single stranded breaks (i.e., nicking). To date, other genome editing techniques, including CRISPR-based systems, begin with the introduction of a DSB at a locus of interest. Subsequently, cellular DNA repair enzymes mend the break, commonly resulting in random insertions or deletions (indels) of bases at the site of the DSB. However, when the introduction or correction of a point mutation at a target locus is desired rather than stochastic disruption of the entire gene, these genome editing techniques are unsuitable, as correction rates are low (e.g. typically 0.1% to 5%), with the major genome editing products being indels. In order to increase the efficiency of gene correction without simultaneously introducing random indels, the present inventors previously modified the CRISPR/Cas9 system to directly convert one DNA base into another without DSB formation. See, Komor, A. C., et al., Programmable editing of a target base in genomic DNA without double-stranded DNA cleavage. Nature 533, 420-424 (2016), the entire contents of which is incorporated by reference herein.

The terms "base editor (BE)" and "nucleobase editor," which are used interchangeably herein, refer to an agent comprising a polypeptide that is capable of making a modification to a base (e.g., A, T, C, G, or U) within a nucleic acid sequence (e.g., DNA or RNA) that converts one base to another (e.g., A to G, A to C, A to T, C to T, C to G, C to A, G to A, G to C, G to T, T to A, T to C, T to G). In some embodiments, the nucleobase editor is capable of deaminating a base within a nucleic acid such as a base within a DNA molecule. In the case of an adenine nucleobase editor, the nucleobase editor is capable of deaminating an adenine (A) in DNA. Such nucleobase editors may include a nucleic acid programmable DNA binding protein (napDNAbp) fused to an adenosine deaminase. Some nucleobase editors include CRISPR-mediated fusion proteins that are utilized in the base editing methods described herein. In some embodiments, the nucleobase editor comprises a nuclease-inactive Cas9 (dCas9) fused to a deaminase which binds a nucleic acid in a guide RNA-programmed manner via the formation of an R-loop, but does not cleave the nucleic acid. For example, the dCas9 domain of the fusion protein may include a D10A and a H840A mutation (which renders Cas9 capable of cleaving only one strand of a nucleic acid duplex), as described in PCT/US2016/058344, which published as WO 2017/070632 on Apr. 27, 2017 and is incorporated herein by reference in its entirety. The DNA cleavage domain of *S. pyogenes* Cas9 includes two subdomains, the HNH nuclease subdomain and the RuvC1 subdomain. The HNH subdomain cleaves the strand complementary to the gRNA (the "targeted strand", or the strand in which editing or deamination occurs), whereas the RuvC1 subdomain cleaves the non-complementary strand containing the PAM sequence (the "non-edited strand"). The RuvC1 mutant D10A generates a nick in the targeted strand, while the HNH mutant H840A generates a nick on the non-edited strand (see Jinek et al., *Science,* 337:816-821(2012); Qi et al., *Cell.* 28; 152(5):1173-83 (2013)).

In some embodiments, a nucleobase editor is a macromolecule or macromolecular complex that results primarily (e.g., more than 80%, more than 85%, more than 90%, more than 95%, more than 99%, more than 99.9%, or 100%) in the conversion of a nucleobase in a polynucleic acid sequence into another nucleobase (i.e., a transition or transversion) using a combination of 1) a nucleotide-, nucleoside-, or nucleobase-modifying enzyme and 2) a nucleic acid binding protein that can be programmed to bind to a specific nucleic acid sequence.

In some embodiments, the nucleobase editor comprises a DNA binding domain (e.g., a programmable DNA binding domain such as a dCas9 or nCas9) that directs it to a target sequence. In some embodiments, the nucleobase editor comprises a nucleobase modification domain fused to a programmable DNA binding domain (e.g., a dCas9 or nCas9). The terms "nucleobase modifying enzyme" and "nucleobase modification domain," which are used interchangeably herein, refer to an enzyme that can modify a nucleobase and convert one nucleobase to another (e.g., a deaminase such as a cytidine deaminase or a adenosine deaminase). The nucleobase modifying enzyme of the the nucleobase editor may target cytosine (C) bases in a nucleic acid sequence and convert the C to thymine (T) base. In some embodiments, C to T editing is carried out by a deaminase, e.g., a cytidine deaminase. In some embodiments, A to G editing is carried out by a deaminase, e.g., an adenosine deaminase. Nucleobase editors that can carry out other types of base conversions (e.g., C to G) are also contemplated.

A "split nucleobase editor" refers to a nucleobase editor that is provided as an N-terminal portion (also referred to as a N-terminal half) and a C-terminal portion (also referred to as a C-terminal half) encoded by two separate nucleic acids. The polypeptides corresponding to the N-terminal portion and the C-terminal portion of the nucleobase editor may be combined to form a complete nucleobase editor. In some embodiments, for a nucleobase editor that comprises a dCas9 or nCas9, the "split" is located in the dCas9 or nCas9 domain, at positions as described herein in the split Cas9. Accordingly, in some embodiments, the N-terminal portion of the nucleobase editor contains the N-terminal portion of the split Cas9, and the C-terminal portion of the nucleobase editor contains the C-terminal portion of the split Cas9. Similarly, intein-N or intein-C may be fused to the N-terminal portion or the C-terminal portion of the nucleobase editor, respectively, for the joining of the N- and C-terminal portions of the nucleobase editor to form a complete nucleobase editor.

In some embodiments, a nucleobase editor converts a C to a T. In some embodiments, the nucleobase editor comprises a cytosine deaminase. A "cytosine deaminase", or "cytidine deaminase," refers to an enzyme that catalyzes the chemical reaction "cytosine+$H_2O$→uracil+$NH_3$" or "5-methyl-cytosine+$H_2O$→thymine+$NH_3$." As it may be apparent from the reaction formula, such chemical reactions result in a C to U/T nucleobase change. In the context of a gene, such a nucleotide change, or mutation, may in turn lead to an amino acid change in the protein, which may affect the protein's function, e.g., loss-of-function or gain-of-function. In some embodiments, the C to T nucleobase editor comprises a dCas9 or nCas9 fused to a cytidine deaminase. In some embodiments, the cytidine deaminase domain is fused to the N-terminus of the dCas9 or nCas9. In some embodiments, the nucleobase editor further comprises a domain that inhibits uracil glycosylase, and/or a nuclear localization signal. Such nucleobase editors have been described in the art, e.g., in Rees & Liu, *Nat Rev Genet.* 2018; 19(12):770-788 and Koblan et al., *Nat Biotechnol.* 2018; 36(9):843-846; as well as U.S. Patent Publication No. 2018/0073012, published Mar. 15, 2018, which issued as U.S. Pat. No. 10,113,163; on Oct. 30, 2018; U.S. Patent Publication No. 2017/0121693, published May 4, 2017, which issued as U.S. Pat. No. 10,167,457 on Jan. 1, 2019; PCT Publication No. WO 2017/070633, published Apr. 27, 2017; U.S. Patent Publication No. 2015/0166980, published Jun. 18, 2015; U.S. Pat. No. 9,840,699, issued Dec. 12, 2017; U.S. Pat. No. 10,077,453, issued Sep. 18, 2018; PCT Publication No. WO 2019/023680, published Jan. 31, 2019; PCT Publication No. WO 2018/0176009, published Sep. 27, 2018, PCT Application No PCT/US2019/033848, filed May 23, 2019, PCT Application No. PCT/US2019/47996, filed Aug. 23, 2019; PCT Application No. PCT/US2019/049793, filed Sep. 5, 2019; International Patent Application No. PCT/US2020/028568, filed Apr. 17, 2020; PCT Application No. PCT/US2019/61685, filed Nov. 15, 2019; PCT Application No. PCT/US2019/57956, filed Oct. 24, 2019; PCT Publication No. PCT/US2019/58678, filed Oct. 29, 2019, the contents of each of which are incorporated herein by reference in their entireties.

In some embodiments, a nucleobase editor converts an A to a G. In some embodiments, the nucleobase editor comprises an adenosine deaminase. An "adenosine deaminase" is an enzyme involved in purine metabolism. It is needed for the breakdown of adenosine from food and for the turnover of nucleic acids in tissues. Its primary function in humans is the development and maintenance of the immune system.

An adenosine deaminase catalyzes hydrolytic deamination of adenosine (forming inosine, which base pairs as G) in the context of DNA. There are no known natural adenosine deaminases that act on DNA. Instead, known adenosine deaminase enzymes only act on RNA (tRNA or mRNA). Evolved deoxyadenosine deaminase enzymes that accept DNA substrates and deaminate dA to deoxyinosine have been described, e.g., in PCT Application PCT/US2017/045381, filed Aug. 3, 2017, which published as WO 2018/027078, PCT Application No. PCT/US2019/033848, which published as WO 2019/226953, PCT Application No PCT/US2019/033848, filed May 23, 2019, and PCT Patent Application No. PCT/US2020/028568, filed Apr. 17, 2020; each of which is herein incorporated by reference by reference.

Exemplary adenosine and cytidine nucleobase editors are also described in Rees & Liu, Base editing: precision chemistry on the genome and transcriptome of living cells, *Nat. Rev. Genet.* 2018; 19(12):770-788; as well as U.S. Patent Publication No. 2018/0073012, published Mar. 15, 2018, which issued as U.S. Pat. No. 10,113,163, on Oct. 30, 2018; U.S. Patent Publication No. 2017/0121693, published May 4, 2017, which issued as U.S. Pat. No. 10,167,457 on Jan. 1, 2019; PCT Publication No. WO 2017/070633, published Apr. 27, 2017; U.S. Patent Publication No. 2015/0166980, published Jun. 18, 2015; U.S. Pat. No. 9,840,699, issued Dec. 12, 2017; and U.S. Pat. No. 10,077,453, issued Sep. 18, 2018, the contents of each of which are incorporated herein by reference in their entireties.

The term "Cas9" or "Cas9 nuclease" refers to an RNA-guided nuclease comprising a Cas9 domain, or a fragment thereof (e.g., a protein comprising an active or inactive DNA cleavage domain of Cas9, and/or the gRNA binding domain of Cas9). A "Cas9 domain" as used herein, is a protein fragment comprising an active or inactive cleavage domain of Cas9 and/or the gRNA binding domain of Cas9. A "Cas9 protein" is a full length Cas9 protein. A Cas9 nuclease is also referred to sometimes as a casnl nuclease or a CRISPR (Clustered Regularly Interspaced Short Palindromic Repeat)-associated nuclease. CRISPR is an adaptive immune system that provides protection against mobile genetic elements (viruses, transposable elements, and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 domain. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which are hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737; the entire contents of which are incorporated herein by reference. In some embodiments, a Cas9 nuclease comprises one or more mutations that partially impair or inactivate the DNA cleavage domain.

A "split Cas9 protein" or "split Cas9" refers to a Cas9 protein that is provided as an N-terminal portion (which is referred to herein interchangeably as an N-terminal half) and a C-terminal portion (which is referred to herein interchangeably as a C-terminal half) encoded by two separate nucleotide sequences. The polypeptides corresponding to the N-terminal portion and the C-terminal portion of the Cas9 protein may be combined (joined) to form a complete Cas9 protein. A Cas9 protein is known to consist of a bi-lobed structure linked by a disordered linker (e.g., as described in Nishimasu et al., *Cell*, Volume 156, Issue 5, pp. 935-949, 2014, incorporated herein by reference). In some embodiments, the "split" occurs between the two lobes, generating two portions of a Cas9 protein, each containing one lobe.

A nuclease-inactivated Cas9 domain may interchangeably be referred to as a "dCas9" protein (for nuclease-"dead" Cas9). Methods for generating a Cas9 domain (or a fragment thereof) having an inactive DNA cleavage domain are known (see, e.g., Jinek et al., *Science.* 337:816-821(2012); Qi et al., "Repurposing CRISPR as an RNA-Guided Platform for Sequence-Specific Control of Gene Expression" (2013) Cell. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, at least about 99.8% identical, or at least about 99.9% identical to wild type Cas9 (e.g., SpCas9 of SEQ ID NO: 1). In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9 (e.g., SpCas9 of SEQ ID NO: 1). In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9 (e.g., SpCas9 of SEQ ID NO: 1). In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SpCas9 of SEQ ID NO: 1).

As used herein, the term "nCas9" or "Cas9 nickase" refers to a Cas9 or a variant thereof, which cleaves or nicks only one of the strands of a target cut site thereby introducing a nick in a double strand DNA molecule rather than creating a double strand break. This can be achieved by introducing appropriate mutations in a wild-type Cas9 which inactivates one of the two endonuclease activities of the Cas9. Any suitable mutation which inactivates one Cas9 endonuclease activity but leaves the other intact is contemplated, such as one of D10A or H840A mutations in the wild-type *S. pyogenes* Cas9 amino acid sequence, or a D10A mutation in the wild-type *S. aureus* Cas9 amino acid sequence, may be used to form the nCas9.

The term "cDNA" refers to a strand of DNA copied from an RNA template. cDNA is complementary to the RNA template.

As used herein, the term "circular permutant" refers to a protein or polypeptide (e.g., a Cas9) comprising a circular permutation, which is change in the protein's structural configuration involving a change in order of amino acids appearing in the protein's amino acid sequence. In other words, circular permutants are proteins that have altered N- and C-termini as compared to a wild-type counterpart, e.g., the wild-type C-terminal half of a protein becomes the new N-terminal half. Circular permutation (or CP) is essentially the topological rearrangement of a protein's primary sequence, connecting its N- and C-terminus, often with a peptide linker, while concurrently splitting its sequence at a different position to create new, adjacent N- and C-termini. The result is a protein structure with different connectivity, but which often can have the same overall similar three-dimensional (3D) shape, and possibly include improved or altered characteristics, including, reduced proteolytic susceptibility, improved catalytic activity, altered substrate or ligand binding, and/or improved thermostability. Circular permutant proteins can occur in nature (e.g., concanavalin A and lectin). In addition, circular permutation can occur as a result of posttranslational modifications or may be engineered using recombinant techniques. Such circularly permuted proteins ("CP-napDNAbp", such as "CP-Cas9" in the case of Cas9), or variants thereof, retain the ability to bind DNA when complexed with a guide RNA (gRNA). See, Oakes et al., "Protein Engineering of Cas9 for enhanced function," *Methods Enzymol,* 2014, 546: 491-511 and Oakes et al., "CRISPR-Cas9 Circular Permutants as Programmable Scaffolds for Genome Modification," *Cell*, Jan. 10, 2019, 176: 254-267, each of are incorporated herein by reference.

The term "circularly permuted Cas9" refers to a Cas9 protein, or variant thereof (e.g., SpCas9), that occurs as or engineered as a circular permutant, whereby its N- and C-termini have been topically rearranged. The instant disclosure contemplates any previously known CP-Cas9 or use a new CP-Cas9 so long as the resulting circularly permuted protein retains the ability to bind DNA when complexed with a guide RNA (gRNA).

As used herein, a "cytosine deaminase" encoded by the CDA gene is an enzyme that catalyzes the removal of an amine group from cytidine (i.e., the base cytosine when attached to a ribose ring) to uridine (C to U) and deoxycytidine to deoxyuridine (C to U). A non-limiting example of a cytosine deaminase is APOBEC1 ("apolipoprotein B mRNA editing enzyme, catalytic polypeptide 1"). Another example is AID ("activation-induced cytosine deaminase"). Under standard Watson-Crick hydrogen bond pairing, a cytosine base hydrogen bonds to a guanine base. When cytidine is converted to uridine (or deoxycytidine is converted to deoxyuridine), the uridine (or the uracil base of uridine) undergoes hydrogen bond pairing with the base adenine. Thus, a conversion of "C" to uridine ("U") by cytosine deaminase will cause the insertion of "A" instead of a "G" during cellular repair and/or replication processes. Since the adenine "A" pairs with thymine "T", the cytosine deaminase in coordination with DNA replication causes the conversion of an C·G pairing to a T·A pairing in the double-stranded DNA molecule.

"CRISPR" is a family of DNA sequences (i.e., CRISPR clusters) in bacteria and archaea that represent snippets of prior infections by a virus that have invaded the prokaryote. The snippets of DNA are used by the prokaryotic cell to detect and destroy DNA from subsequent attacks by similar viruses and effectively compose, along with an array of CRISPR-associated proteins (including Cas9 and homologs thereof) and CRISPR-associated RNA, a prokaryotic immune defense system. In nature, CRISPR clusters are transcribed and processed into CRISPR RNA (crRNA). In certain types of CRISPR systems (e.g., type II CRISPR systems), correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species—the guide RNA. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. CRISPR biology, as well as Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

The term "deaminase" or "deaminase domain" refers to a protein or enzyme that catalyzes a deamination reaction. In some embodiments, the deaminase is an adenosine (or adenine) deaminase, which catalyzes the hydrolytic deamination of adenine or adenosine. In some embodiments, the adenosine deaminase catalyzes the hydrolytic deamination of adenine or adenosine in deoxyribonucleic acid (DNA) to inosine. In other embodiments, the deminase is a cytidine (or cytosine) deaminase, which catalyzes the hydrolytic deamination of cytidine or cytosine.

The deaminases provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

As used herein, the term "DNA binding protein" or "DNA binding protein domain" refers to any protein that localizes to and binds a specific target DNA nucleotide sequence (e.g. a gene locus of a genome). This term embraces RNA-programmable proteins, which associate (e.g. form a complex) with one or more nucleic acid molecules (i.e., which includes, for example, guide RNA in the case of Cas systems) that direct or otherwise program the protein to localize to a specific target nucleotide sequence (e.g., DNA sequence) that is complementary to the one or more nucleic acid molecules (or a portion or region thereof) associated with the protein. Exemplary RNA-programmable proteins are CRISPR-Cas9 proteins, as well as Cas9 equivalents, homologs, orthologs, or paralogs, whether naturally occurring or non-naturally occurring (e.g. engineered or modified), and may include a Cas9 equivalent from any type of CRISPR system (e.g. type II, V, VI), including Cpf1 (a type-V CRISPR-Cas systems) (now known as Cas12a), C2c1 (a type V CRISPR-Cas system), C2c2 (a type VI CRISPR-Cas system), C2c3 (a type V CRISPR-Cas system), dCas9, GeoCas9, CjCas9, Cas12b, Cas12c, Cas12d, Cas12g, Cas12h, Cas12i, Cas13d, Cas14, Argonaute, and nCas9. Further Cas-equivalents are described in Makarova et al., "C2c2 is a single-component programmable RNA-guided RNA-targeting CRISPR effector," *Science* 2016; 353(6299), the contents of which are incorporated herein by reference.

The term "DNA editing efficiency," as used herein, refers to the number or proportion of intended base pairs that are edited. For example, if a nucleobase editor edits 10% of the base pairs that it is intended to target (e.g., within a cell or within a population of cells), then the nucleobase editor can be described as being 10% efficient. Some aspects of editing efficiency embrace the modification (e.g. deamination) of a specific nucleotide within DNA, without generating a large number or percentage of insertions or deletions (i.e., indels). It is generally accepted that editing while generating less than 5% indels (as measured over total target nucleotide substrates) is high editing efficiency. The generation of more than 20% indels is generally accepted as poor or low editing efficiency. Indel formation may be measured by techniques known in the art, including high-throughput screening of sequencing reads.

The term "off-target editing frequency," as used herein, refers to the number or proportion of unintended base pairs, e.g. DNA base pairs, that are edited. On-target and off-target editing frequencies may be measured by the methods and assays described herein, further in view of techniques known in the art, including high-throughput sequencing reads. As used herein, high-throughput sequencing involves the hybridization of nucleic acid primers (e.g., DNA primers) with complementarity to nucleic acid (e.g., DNA) regions just upstream or downstream of the target sequence or off-target sequence of interest. Because the DNA target sequence and the Cas9-independent off-target sequences are known a priori in the methods disclosed herein, nucleic acid primers with sufficient complementarity to regions upstream or downstream of the target sequence and Cas9-independent off-target sequences of interest may be designed using techniques known in the art, such as the PhusionU PCR kit (Life Technologies), Phusion HS II kit (Life Technologies), and Illumina MiSeq kit. Since many of the Cas9-dependent off-target sites have high sequence identity to the target site of interest, nucleic acid primers with sufficient complementarity to regions upstream or downstream of the Cas9-dependent off-target site may likewise be designed using techniques and kits known in the art. These kits make use of polymerase chain reaction (PCR) amplification, which produces amplicons as intermediate products. The target and off-target sequences may comprise genomic loci that further comprise protospacers and PAMs. Accordingly, the term "amplicons," as used herein, may refer to nucleic acid molecules that constitute the aggregates of genomic loci, protospacers and PAMs. High-throughput sequencing techniques used herein may further include Sanger sequencing and Illumina-based next-generation genome sequencing (NGS).

The term "on-target editing," as used herein, refers to the introduction of intended modifications (e.g., deaminations) to nucleotides (e.g., adenine) in a target sequence, such as using the nucleobase editors described herein. The term "off-target DNA editing," as used herein, refers to the introduction of unintended modifications (e.g. deaminations) to nucleotides (e.g. adenine) in a sequence outside the canonical nucleobase editor binding window (i.e., from one protospacer position to another, typically 2 to 8 nucleotides long). Off-target DNA editing can result from weak or non-specific binding of the gRNA sequence to the target sequence.

As used herein, the terms "upstream" and "downstream" are terms of relativety that define the linear position of at least two elements located in a nucleic acid molecule (whether single or double-stranded) that is orientated in a 5'-to-3' direction. In particular, a first element is upstream of a second element in a nucleic acid molecule where the first element is positioned somewhere that is 5' to the second element. For example, a SNP is upstream of a Cas9-induced nick site if the SNP is on the 5' side of the nick site. Conversely, a first element is downstream of a second element in a nucleic acid molecule where the first element is positioned somewhere that is 3' to the second element. For example, a SNP is downstream of a Cas9-induced nick site if the SNP is on the 3' side of the nick site. The nucleic acid molecule can be a DNA (double or single stranded). RNA (double or single stranded), or a hybrid of DNA and RNA. The analysis is the same for single strand nucleic acid molecule and a double strand molecule since the terms upstream and downstream are in reference to only a single strand of a nucleic acid molecule, except that one needs to select which strand of the double stranded molecule is being considered. Often, the strand of a double stranded DNA which can be used to determine the positional relativity of at least two elements is the "sense" or "coding" strand. In genetics, a "sense" strand is the segment within double-stranded DNA that runs from 5' to 3', and which is complementary to the antisense strand of DNA, or template strand, which runs from 3' to 5'. Thus, as an example, a SNP nucleobase is "downstream" of a promoter sequence in a genomic DNA (which is double-stranded) if the SNP nucleobase is on the 3' side of the promoter on the sense or coding strand.

The term "base edit:indel ratio," as used herein, refers to the ratio of intended DNA nucleobase modifications (e.g., point mutations or deaminations) to formation of indels.

The term "effective amount," as used herein, refers to an amount of a biologically active agent that is sufficient to elicit a desired biological response. For example, in some embodiments, an effective amount of a nucleobase editor may refer to the amount of the editor that is sufficient to edit a target site nucleotide sequence, e.g., a genome. In some embodiments, an effective amount of a nucleobase editor provided herein, e.g., of a fusion protein comprising a nickase Cas9 domain and a guide RNA may refer to the amount of the fusion protein that is sufficient to induce editing of a target site specifically bound and edited by the fusion protein. As will be appreciated by the skilled artisan, the effective amount of an agent, e.g., a fusion protein, a nuclease, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The term "functional equivalent" refers to a second biomolecule that is equivalent in function, but not necessarily equivalent in structure to a first biomolecule. For example, a "Cas9 equivalent" refers to a protein that has the same or substantially the same functions as Cas9, but not necessarily the same amino acid sequence. In the context of the disclosure, the specification refers throughout to "a protein X, or a functional equivalent thereof." In this context, a "functional equivalent" of protein X embraces any homolog, paralog, fragment, naturally occurring, engineered, circular permutant, mutated, or synthetic version of protein X which bears an equivalent function.

The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. Another example includes a Cas9 or equivalent thereof fused to an adenosine deaminae. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* ($4^{th}$ ed., Cold Spring Harbor Laboratory Press, Cold Spring Harbor, N.Y. (2012)), the entire contents of which are incorporated herein by reference.

Two proteins or protein domains are considered to be "fused" when a peptide bond is formed linking the two proteins or two protein domains. In some embodiments, a linker (e.g., a peptide linker) is present between the two proteins or two protein domains. The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linke are also contemplated.

The term "guide nucleic acid" or "napDNAbp-programming nucleic acid molecule" or equivalently "guide sequence" refers the one or more nucleic acid molecules which associate with and direct or otherwise program a napDNAbp protein to localize to a specific target nucleotide sequence (e.g., a gene locus of a genome) that is complementary to the one or more nucleic acid molecules (or a portion or region thereof) associated with the protein, thereby causing the napDNAbp protein to bind to the nucleotide sequence at the specific target site. A non-limiting example is a guide RNA of a Cas protein of a CRISPR-Cas genome editing system. Chemically, guide nucleic acids can be all RNA, all DNA, or a chimeric of RNA and DNA. The guide nucleic acids may also include nucleotide analogs. Guide nucleic acids can be expressed as transcription products or can be synthesized.

As used herein, a "guide RNA" can refer to a synthetic fusion of the endogenous bacterial crRNA and tracrRNA that provides both targeting specificity and a scaffold and/or binding ability for Cas9 nuclease to a target DNA. This synthetic fusion does not exist in nature and is also commonly referred to as an sgRNA. However, the term, guide RNA, also embraces equivalent guide nucleic acid molecules that associate with Cas9 equivalents, homologs, orthologs, or paralogs, whether naturally occurring or non-naturally occurring (e.g., engineered or recombinant), and which otherwise program the Cas9 equivalent to localize to a specific target nucleotide sequence. The Cas9 equivalents may include other napDNAbps from any type of CRISPR system (e.g., type II, V, VI), including Cpf1 (a type-V CRISPR-Cas systems) (now known as Cas12a), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference. Exemplary sequences are and structures of guide RNAs are provided herein. In addition, methods for designing appropriate guide RNA sequences are provided herein.

A guide RNA is a particular type of guide nucleic acid which is mostly commonly associated with a Cas protein of a CRISPR-Cas9 and which associates with Cas9, directing the Cas9 protein to a specific sequence in a DNA molecule that includes complementarity to the protospacer sequence for the guide RNA. Functionally, guide RNAs associate with Cas9, directing (or programming) the Cas9 protein to a specific sequence in a DNA molecule that includes a sequence complementary to the protospacer sequence for the guide RNA. A gRNA is a component of the CRISPR/Cas system. Typically, a guide RNA comprises a fusion of a CRISPR-targeting RNA (crRNA) and a trans-activation crRNA (tracrRNA), providing both targeting specificity and scaffolding/binding ability for Cas9 nuclease. A "crRNA" is a bacterial RNA that confers target specificity and requires tracrRNA to bind to Cas9. A "tracrRNA" is a bacterial RNA that links the crRNA to the Cas9 nuclease and typically can bind any crRNA. The sequence specificity of a Cas DNA-binding protein is determined by gRNAs, which have nucleotide base-pairing complementarity to target DNA sequences. The native gRNA comprises a 20 nucleotide (nt) Specificity Determining Sequence (SDS), or spacer, which specifies the DNA sequence to be targeted, and is immediately followed by a 80 nt scaffold sequence, which associates the gRNA with Cas9. In some embodiments, an SDS of the present disclosure has a length of 15 to 100 nucleotides, or more. For example, an SDS may have a length of 15 to 90, 15 to 85, 15 to 80, 15 to 75, 15 to 70, 15 to 65, 15 to 60, 15 to 55, 15 to 50, 15 to 45, 15 to 40, 15 to 35, 15 to 30, or 15 to 20 nucleotides. In some embodiments, the SDS is 20 nucleotides long. For example, the SDS may be 15, 16, 17, 18, 19, 20, 21, 22, 23, 24, or 25 nucleotides long. At least a portion of the target DNA sequence is complementary to the SDS of the gRNA. For Cas9 to successfully bind to the DNA target sequence, a region of the target sequence is complementary to the SDS of the gRNA sequence and is immediately followed by the correct protospacer adjacent motif (PAM) sequence (e.g., NGG for Cas9 and TTN, TTTN, or YTN for Cpf1). In some embodiments, an SDS is 100% complementary to its target sequence. In some embodiments, the SDS sequence is less than 100% complementary to its target sequence and is, thus, considered to be partially complementary to its target sequence. For example, a targeting sequence may be 99%, 98%, 97%, 96%, 95%, 94%, 93%, 92%, 91%, or 90% complementary to its target sequence. In some embodiments, the SDS of template DNA or target DNA may differ from a complementary region of a gRNA by 1, 2, 3, 4 or 5 nucleotides.

In some embodiments, the guide RNA is about 15-120 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 97, 98, 99, 100, 101, 102, 103, 104, 105, 106, 107, 108, 109, 110, 111, 112, 113, 114, 115, 116, 117, 118, 119, or 120 nucleotides long. In some embodiments, the guide RNA comprises a sequence of 10, 11, 12, 13, 14, 15, 16, 17, 18, 19, 20 or more contiguous nucleotides that is complementary to a target sequence. Sequence complementarity refers to distinct interactions between adenine and thymine (DNA) or uracil (RNA), and between guanine and cytosine.

As used herein, a "spacer sequence" is the sequence of the guide RNA (~20 nts in length) which has the same sequence (with the exception of uridine bases in place of thymine bases) as the protospacer of the PAM strand of the target (DNA) sequence, and which is complementary to the target strand (or non-PAM strand) of the target sequence.

As used herein, the "target sequence" refers to the ~20 nucleotides in the target DNA sequence that have complementarity to the protospacer sequence in the PAM strand. The target sequence is the sequence that anneals to or is targeted by the spacer sequence of the guide RNA. The spacer sequence of the guide RNA and the protospacer have the same sequence (except the spacer sequence is RNA, and the protospacer is DNA).

As used herein, the terms "guide RNA core," "guide RNA scaffold sequence" and "backbone sequence," which are used interchangeably, refer to the region (or sequence) within the gRNA that is responsible for Cas9 binding. It does not include the 20 bp spacer sequence that is used to guide Cas9 to target DNA. This region also known as the crRNA/tracrRNA. The guide RNA backbone sequence is separate from the guide sequence, or spacer, region of the guide RNA, which has complementarity to a protospacer of a nucleic acid molecule.

As used herein, the term "protospacer" refers to the sequence (e.g., a ~20 bp sequence) in DNA adjacent to the PAM (protospacer adjacent motif) sequence which shares the same sequence as the spacer sequence of the guide RNA, and which is complementary to the target sequence of the non-PAM strand. The spacer sequence of the guide RNA anneals to the target sequence located on the non-PAM strand. In order for Cas9 to function it also requires a specific protospacer adjacent motif (PAM) that varies depending on the bacterial species of the Cas9 gene. The most commonly used Cas9 nuclease, derived from *S. pyogenes*, recognizes a PAM sequence of NGG that is found directly downstream of the protospacer sequence in the genomic DNA, on the non-target strand. The skilled person will appreciate that the literature in the state of the art sometimes refers to the "protospacer" as the ~20-nt target-specific guide sequence on the guide RNA itself, rather than referring to it as a "spacer" (and that the protospacer (DNA) and the spacer (RNA) have the same sequence). Thus, the term "protospacer" as used herein may be used interchangeably with the term "spacer." The context of the discription surrounding the appearance of either "protospacer" or "spacer" will help inform the reader as to whether the term is reference to the gRNA or the DNA sequence. Both usages of these terms are acceptable since the state of the art uses both terms in each of these ways.

A "protospacer adjacent motif" (PAM) is typically a sequence of nucleotides located adjacent to (e.g., within 10, 9, 8, 7, 6, 5, 4, 3, 3, or 1 nucleotide(s) of a target sequence). A PAM sequence is "immediately adjacent to" a target sequence if the PAM sequence is contiguous with the target sequence (that is, if there are no nucleotides located between the PAM sequence and the target sequence). In some embodiments, a PAM sequence is a wild-type PAM sequence. Examples of PAM sequences include, without limitation, NGG, NGR, NNGRR(T/N), NNNNGATT, NNAGAAW, NGGAG, NAAAAC, AWG, and CC. In some embodiments, a PAM sequence is obtained from *Streptococcus pyogenes* (e.g., NGG or NGR). In some embodiments, a PAM sequence is obtained from *Staphylococcus aureus* (e.g., NNGRR(T/N)). In some embodiments, a PAM sequence is obtained from *Neisseria meningitidis* (e.g., NNNNGATT). In some embodiments, a PAM sequence is obtained from *Streptococcus thermophilus* (e.g., NNAGAAW or NGGAG). In some embodiments, a PAM sequence is obtained from *Treponema denticola* (e.g., NAAAAC). In some embodiments, a PAM sequence is obtained from *Escherichia coli* (e.g., AWG). In some embodiments, a PAM sequence is obtained from *Pseudomonas auruginosa* (e.g., CC). Other PAM sequences are contemplated. A PAM sequence is typically located downstream (i.e., 3') from the target sequence, although in some embodiments a PAM sequence may be located upstream (i.e., 5') from the target sequence.

The term "host cell," as used herein, refers to a cell that can host, replicate, and transfer a phage vector useful for a continuous evolution process as provided herein. In embodiments where the vector is a viral vector, a suitable host cell is a cell that may be infected by the viral vector, can replicate it, and can package it into viral particles that can infect fresh host cells. A cell can host a viral vector if it supports expression of genes of viral vector, replication of the viral genome, and/or the generation of viral particles. One criterion to determine whether a cell is a suitable host cell for a given viral vector is to determine whether the cell can support the viral life cycle of a wild-type viral genome that the viral vector is derived from. For example, if the viral vector is a modified M13 phage genome, as provided in some embodiments described herein, then a suitable host cell would be any cell that can support the wild-type M13 phage life cycle. Suitable host cells for viral vectors useful in continuous evolution processes are well known to those of skill in the art, and the disclosure is not limited in this respect. In some embodiments, the viral vector is a phage and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, and XL1-Blue MRF'. These strain names are art recognized and the genotype of these strains has been well characterized. It should be understood that the above strains are exemplary only and that the invention is not limited in this respect. The term "fresh," as used herein interchangeably with the terms "non-infected" or "uninfected" in the context of host cells, refers to a host cell that has not been infected by a viral vector comprising a gene of interest as used in a continuous evolution process provided herein. A fresh host cell can, however, have been infected by a viral vector unrelated to the vector to be evolved or by a vector of the same or a similar type but not carrying the gene of interest.

In some embodiments, the host cell is a prokaryotic cell, for example, a bacterial cell. In some embodiments, the host cell is an *E. coli* cell. In some embodiments, the host cell is a eukaryotic cell, for example, a yeast cell, a plant cell, an insect cell, or a mammalian cell. In some embodiments, the cell is a human cell. The type of host cell, will, of course, depend on the viral vector employed, and suitable host cell/viral vector combinations will be readily apparent to those of skill in the art.

An "intein" is a segment of a protein that is able to excise itself and join the remaining portions (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein. For example, in cyanobacteria, DnaE, the catalytic subunit a of DNA polymerase III, is encoded by two separate genes, dnaE-n and dnaE-c. The intein encoded by the dnaE-n gene is herein referred as "intein-N." The intein encoded by the dnaE-c gene is herein referred as "intein-C."

Other intein systems may also be used. For example, a synthetic intein based on the dnaE intein, the Cfa-N and Cfa-C intein pair, has been described (e.g., in Stevens et al., J Am Chem Soc. 2016 Feb. 24; 138(7):2162-5, incorporated herein by reference). As another example, a synthetic intein based on the dnaE intein, the *Nostoc punctiforme* (Npu) intein pair, has been described (see Zettler, J., Schutz, V. & Mootz, H. D., The naturally split Npu DnaE intein exhibits an extraordinarily high rate in the protein trans-splicing reaction. *FEBS letters* 583, 909-914 (2009), incorporated herein by reference). Non-limiting examples of intein pairs that may be used in accordance with the present disclosure include: Cfa DnaE intein, Npu DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference).

Exemplary nucleotide and amino acid sequences of inteins are provided below, as SEQ ID NOs: 350-357. In some embodiments, the inteins used in accordance with the disclosed napDNAbp domains (e.g., Cas9 domains) comprise the Npu intein-N comprising the amino acid sequence of SEQ ID NO: 351 and the the Npu intein-C comprising the amino acid sequence of SEQ ID NO: 353. In some embodiments, the inteins used in accordance with the disclosed nucleobase editors comprise the Npu intein-N comprising the amino acid sequence of SEQ ID NO: 351 and the Npu intein-C comprising the amino acid sequence of SEQ ID NO: 353. In some embodiments, the inteins used in accordance with the disclosed constructs encoding any of the disclosed napDNAbp domains (e.g., a Cas9 domain) comprise the Npu intein-N DNA comprising the nucleotide sequence of SEQ ID NO: 350 and the the Npu intein-C DNA comprising the nucleotide sequence of SEQ ID NO: 352. In some embodiments, the inteins used in accordance with the disclosed constructs encoding any of the disclosed nucleobase editors comprise the Npu intein-N DNA comprising the nucleotide sequence of SEQ ID NO: 350 and the Npu intein-C DNA comprising the nucleotide sequence of SEQ ID NO: 352.

In some embodiments, the intein-N comprises an amino acid sequence that is at least 90%, 95%, 98%, or 99% identical to the amino acid of SEQ ID NOs: 351 or 355. In some embodiments, the intein-N comprises an amino acid sequence that differs from the amino acid of SEQ ID NOs: 351 or 355 by 1, 2, 3, 4, 5, 6, or 7 amino acids. In some embodiments, the intein-N comprises the amino acid sequence of SEQ ID NOs: 351 or 355. In some embodiments, the intein-N used in accordance with the disclosed constructs comprises a nucleotide sequence that is at least 90%, 95%, 98%, or 99% identical to the nucleotide sequence of SEQ ID NOs: 350 or 354. In some embodiments, the intein-N used in accordance with the disclosed constructs comprises a nucleotide sequence that differs by 1, 2, 3, 4, 5, 6, 7, 8, 9, 10, or 10-15 nucleotides from the nucleotide sequence of SEQ ID NOs: 350 or 354.

In some embodiments, the intein-C comprises an amino acid sequence that is at least 90%, 95%, 98%, or 99% identical to the amino acid of SEQ ID NOs: 353 or 357. In some embodiments, the intein-C comprises an amino acid sequence that differs from the amino acid of SEQ ID NOs: 353 or 357 by 1, 2, 3, 4, or 5 amino acids. In some embodiments, the intein-C comprises the amino acid sequence of SEQ ID NOs: 351 or 355. In some embodiments, the intein-C used in accordance with the disclosed constructs comprises a nucleotide sequence that is at least 90%, 95%, 98%, or 99% identical to the nucleotide sequence of SEQ ID NOs: 352 or 356. In some embodiments, the intein-C used in accordance with the disclosed constructs comprises a nucleotide sequence that differs by 1, 2, 3, 4, 5, 6, 7, 8, 9, or 10 nucleotides from the nucleotide sequence of SEQ ID NOs: 352 or 356.

In particular embodiments, the intein-N comprises the amino acid sequence as set forth in SEQ ID NO: 355. In some embodiments, the intein-C comprises the amino acid sequence as set forth in SEQ ID NO: 357.

```
DnaE Intein-N DNA:
                                        (SEQ ID NO: 350)
TGCCTGTCATACGAAACCGAGATACTGACAGTAGAATATGGCCTTCTGCC

AATCGGGAAGATTGTGGAGAAACGGATAGAATGCACAGTTTACTCTGTCG

ATAACAATGGTAAATTTATACTCAGCCAGTTGCCCAGTGGCACGACCGGG

GAGAGCAGGAAGTATTCGAATACTGTCTGGAGGATGGAAGTCTCATTAGG

GCCACTAAGGACCACAAATTTATGACAGTCGATGGCCAGATGCTGCCTAT

AGACGAAATCTTTGAGCGAGAGTTGGACCTCATGCGAGTTGACAACCTTC

CTAAT

Npu DnaE N-terminal Protein:
                                        (SEQ ID NO: 351)
CLSYETEILTVEYGLLPIGKIVEKRIECTVYSVDNNGNIYTQPVAQWHDR

GEQEVFEYCLEDGSLIRATKDHKFMTVDGQMLPIDEIFERELDLMRVDNL

PN

DnaE Intein-C DNA:
                                        (SEQ ID NO: 352)
ATGATCAAGATAGCTACAAGGAAGTATCTTGGCAAACAAAACGTTTATGA

TATTGGAGTCGAAAGAGATCACAACTTTGCTCTGAAGAACGGATTCATAG

CTTCTAAT

Npu DnaE C-terminal Protein:
                                        (SEQ ID NO: 353)
MIKIATRKYLGKQNVYDIGVERDHNFALKNGFIASN
```

-continued

```
Cfa-N DNA:
                                        (SEQ ID NO: 354)
TGCCTGTCTTATGATACCGAGATACTTACCGTTGAATATGGCTTCTTGCC

TATTGGAAAGATTGTCGAAGAGAGAATTGAATGCACAGTATATACTGTAG

ACAAGAATGGTTTCGTTTACACACAGCCCATTGCTCAATGGCACAATCGC

GGCGAACAAGAAGTATTTGAGTACTGTCTCGAGGATGGAAGCATCATACG

AGCAACTAAAGATCATAAATTCATGACCACTGACGGGCAGATGTTGCCAA

TAGATGAGATATTCGAGCGGGGCTTGGATCTCAAACAAGTGGATGGATTG

CCA

Cfa-N Protein:
                                        (SEQ ID NO: 355)
CLSYDTEILTVEYGFLPIGKIVEERIECTVYTVDKNGFVYTQPIAQWHNR

GEQEVFEYCLEDGSIIRATKDHKFMTTDGQMLPIDEIFERGLDLKQVDGL

P

Cfa-C DNA:
                                        (SEQ ID NO: 356)
ATGAAGAGGACTGCCGATGGATCAGAGTTTGAATCTCCCAAGAAGAAGAG

GAAAGTAAAGATAATATCTCGAAAAAGTCTTGGTACCCAAAATGTCTATG

ATATTGGAGTGGAGAAAGATCACAACTTCCTTCTCAAGAACGGTCTCGTA

GCCAGCAAC

Cfa-C Protein:
                                        (SEQ ID NO: 357)
MKRTADGSEFESPKKKRKVKIISRKSLGTQNVYDIGVEKDHNFLLKNGLV

ASN
```

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N-[N-terminal portion of the split Cas9]-[intein-N]-C. In some embodiments, an intein-C is fused to the N-terminus of the C-terminal portion of the split Cas9, i.e., to form a structure of N-[intein-C]-[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5(1):446-461, incorporated herein by reference.

The term "mutation," as used herein, refers to a substitution of a residue within a sequence, e.g. a nucleic acid or amino acid sequence, with another residue; a deletion or insertion of one or more residues within a sequence; or a substitution of a residue within a sequence of a genome in a subject to be corrected. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which are mutations that reduce or abolish a protein activity. Most loss-of-function mutations are recessive, because in a heterozygote the second chromosome copy carries an unmutated version of the gene coding for a fully functional protein whose presence compensates for the effect of the mutation. There are some exceptions where a loss-of-function mutation is dominant, one example being haploinsufficiency, where the organism is unable to tolerate the approximately 50% reduction in protein activity suffered by the heterozygote. This is the explanation for a few genetic diseases in humans, including Marfan syndrome, which results from a mutation in the gene for the connective tissue protein called fibrillin. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. Because of their nature, gain-of-function mutations are usually dominant. Many loss-of-function mutations are recessive, such as autosomal recessive.

The term "napDNAbp" which stand for "nucleic acid programmable DNA binding protein" refers to any protein that may associate (e.g., form a complex) with one or more nucleic acid molecules (i.e., which may broadly be referred to as a "napDNAbp-programming nucleic acid molecule" and includes, for example, guide RNA in the case of Cas systems) which direct or otherwise program the protein to localize to a specific target nucleotide sequence (e.g., a gene locus of a genome) that is complementary to the one or more nucleic acid molecules (or a portion or region thereof) associated with the protein, thereby causing the protein to bind to the nucleotide sequence at the specific target site. This term napDNAbp embraces CRISPR-Cas9 proteins, as well as Cas9 equivalents, homologs, orthologs, or paralogs, whether naturally occurring or non-naturally occurring (e.g., engineered or modified), and may include a Cas9 equivalent from any type of CRISPR system (e.g., type II, V, VI), including Cpf1 (a type-V CRISPR-Cas systems) (now known as Cas12a), C2c1 (a type V CRISPR-Cas system), C2c2 (a type VI CRISPR-Cas system), C2c3 (a type V CRISPR-Cas system), dCas9, GeoCas9, CjCas9, Cas12a, Cas12b, Cas12c, Cas12d, Cas12g, Cas12h, Cas12i, Cas13d, Cas14, Argonaute, and nCas9. Further Cas-equivalents are described in Makarova et al., "C2c2 is a single-component programmable RNA-guided RNA-targeting CRISPR effector," Science 2016; 353 (6299), the contents of which are incorporated herein by reference. However, the nucleic acid programmable DNA binding protein (napDNAbp) that may be used in connection with this invention are not limited to CRISPR-Cas systems. The invention embraces any such programmable protein, such as the Argonaute protein from *Natronobacterium gregoryi* (NgAgo) which may also be used for DNA-guided genome editing. NgAgo-guide DNA system does not require a PAM sequence or guide RNA molecules, which means genome editing can be performed simply by the expression of generic NgAgo protein and introduction of synthetic oligonucleotides on any genomic sequence. See Gao et al., DNA-guided genome editing using the *Natronobacterium gregoryi* Argonaute. *Nature Biotechnology* 2016; 34(7):768-73, which is incorporated herein by reference.

In some embodiments, the napDNAbp is a RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 (or equivalent) complex to the target); and (2) a domain that binds a Cas9 protein. In some embodiments, domain (2) corresponds to a sequence known as a tracrRNA, and comprises a stem-loop structure. For example, in some embodiments, domain (2) is homologous to a tracrRNA as depicted in FIG. 1E of Jinek et al., *Science* 337:816-821(2012), the entire contents of which is incorporated herein by reference. Other examples of gRNAs (e.g., those including domain 2) can be found in U.S. Pat. No. 9,340,799, entitled "mRNA-Sensing Switchable gRNAs," and International Patent Application No. PCT/US2014/054247, filed Sep. 6, 2013, published as WO 2015/035136 and entitled "Delivery System For Functional Nucleases," the entire contents of each are herein incorporated by reference. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J. et al., *Proc. Natl. Acad. Sci. U.S.A.* 98:4658-4663(2001); "CRISPR RNA maturation by trans-encoded small RNA and host factor RNase III." Deltcheva E. et al., *Nature* 471:602-607(2011); and "A programmable dual-RNA-guided DNA endonuclease in adaptive bacterial immunity." Jinek M. et al., *Science* 337: 816-821(2012), the entire contents of each of which are incorporated herein by reference.

The napDNAbp nucleases (e.g., Cas9) use RNA:DNA hybridization to target DNA cleavage sites, these proteins are able to be targeted, in principle, to any sequence specified by the guide RNA. Methods of using napDNAbp nucleases, such as Cas9, for site-specific cleavage (e.g., to modify a genome) are known in the art (see e.g., Cong, L. et al. Multiplex genome engineering using CRISPR/Cas systems. *Science* 339, 819-823 (2013); *Mali*, P. et al. RNA-guided human genome engineering via Cas9. *Science* 339, 823-826 (2013); Hwang, W. Y. et al. Efficient genome editing in zebrafish using a CRISPR-Cas system. *Nature Biotechnology* 31, 227-229 (2013); Jinek, M. et al. RNA-programmed genome editing in human cells. *eLife* 2, e00471 (2013); Dicarlo, J. E. et al., Genome engineering in *Saccharomyces cerevisiae* using CRISPR-Cas systems. *Nucleic Acid Res*. (2013); Jiang, W. et al. RNA-guided editing of bacterial genomes using CRISPR-Cas systems. *Nature Biotechnology* 31, 233-239 (2013); the entire contents of each of which are incorporated herein by reference).

The term "nickase" refers to a napDNAbp (e.g., a Cas9) having only a single nuclease activity that cuts only one strand of a target DNA, rather than both strands. Thus, a nickase type napDNAbp does not leave a double-strand break. Exemplary nickases include SpCas9 and SaCas9 nickases. An exemplary nickase comprises a sequence having at least 99%, or 100%, identity to the amino acid sequence of SEQ ID NO: 3 or 11.

A "uracil glycosylase inhibitor (UGI)" refers to a protein that inhibits the activity of uracil-DNA glycosylase. Suitable UGI proteins for use in accordance with the present disclosure include, for example, those published in Wang et al., *J. Biol. Chem.* 264:1163-1171(1989); Lundquist et al., *J. Biol. Chem.* 272:21408-21419(1997); Ravishankar et al., *Nucleic Acids Res.* 26:4880-4887(1998); and Putnam et al., *J. Mol. Biol.* 287:331-346 (1999), each of which is incorporated herein by reference. Non-limiting, exemplary proteins that may be used as a UGI of the present disclosure and their respective sequences are provided below. In some embodiments, the UGI is a variant of a naturally-occurring deaminase from an organism, and the variants do not occur in nature. For example, in some embodiments, the UGI is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring UGI from an organism or any UGIs provided herein (e.g., a UGI comprising the amino acid sequence of any one of SEQ ID NOs: 299-302). In some embodiments, the UGI comprises an amino acid sequence that is shorter or longer in length (e.g., by no more than 30%, no more than 25%, no more than 20%, no more than 15%, no more than 10%, no more than 5%, no more than 1% longer or shorter) than any of the UGIs provided herein. In some embodiments, the UGI comprises an amino acid sequence that is shorter or longer in length (e.g., by no more than 20 amino acids, no more than 15 amino acids, no more than 10 amino acids, no more than 5 amino acids, no more than 2 amino acids longer or shorter) than any of the UGIs provided herein.

A "nuclear localization signal" or "NLS" refers to as an amino acid sequence that "tags" a protein for import into the cell nucleus by nuclear transport. Typically, this signal consists of one or more short sequences of positively charged lysines or arginines exposed on the protein surface. One or more NLS may be added to the N- or C-terminus of a protein, or internally (e.g., between two protein domains). For example, one or more NLS may be added to the N- or C-terminus of a nucleobase editor, or between the Cas9 and the deaminase in a nucleobase editor. In some embodiments, 1, 2, 3, 4, 5, or more NLS may be added. Nuclear localization sequences are known in the art and would be apparent to the skilled artisan. For example, NLS sequences are described in Plank et al., PCT/EP2000/011690, filed Nov. 23, 2000, the contents of which are incorporated herein by reference for its disclosure of exemplary nuclear localization sequences. In some embodiments, a NLS comprises a bipartite nuclear localization signal comprising an amino acid sequence selected from the group consisting of KRTADGSEFEPKKKRKV (SEQ ID NO: 398), KRPAATKKAGQAKKKK (SEQ ID NO: 344), KKTELQTTNAENKTKKL (SEQ ID NO: 345), KRGINDRNFWRGENGRKTR(SEQ ID NO: 346), RKSGKIAAIVVKRPRK (SEQ ID NO: 347), PKKKRKV (SEQ ID NO: 373) or MDSLLMNRRKFLYQFKNVRWAKGRRETYLC (SEQ ID NO: 374). In some embodiments, a linker is inserted between the Cas9 and the deaminase. In certain embodiments, the NLS comprises the amino acid sequence of SEQ ID NO: 398. In some embodiments, the NLS comprises the amino acid sequence of SEQ ID NO: 344.

An NLS can be classified as monopartite or bipartite. A non-limiting example of a monopartite NLS is the sequence PKKKRKV (SEQ ID NO: 373) in the SV40 Large T-antigen. A "bipartite" NLS typically contains two clusters of basic amino acids, separated by a spacer of about 10 amino acids. One non-limiting example of a bipartite NLS is the NLS of nucleoplasmin, KRPAATKKAGQAKKKK (spacer underlined) (SEQ ID NO: 344). In some embodiments, the NLS used in accordance with the present disclosure is the NLS of nucleoplasmin comprising the amino acid sequence of KRPAATKKAGQAKKKK (SEQ ID NO: 344). Other bipartite NLSs that may be used in accordance with the present disclosure include, without limitation: SV40 bipartite NLS (KRTADGSEFESPKKKRKV (SEQ ID NO: 375), e.g., as described in Hodel et al., *J Biol Chem.* 2001 Jan. 12; 276(2):1317-25, incorporated herein by reference); Kanadaptin bipartite NLS (KKTELQTTNAENKTKKL (SEQ ID NO: 345), e.g., as described in Hubner et al., *Biochem J.* 2002 Jan. 15; 361 (Pt 2):287-96, incorporated herein by reference); influenza A nucleoprotein bipartite NLS (KRGINDRNFWRGENGRKTR (SEQ ID NO: 346), e.g., as described in Ketha et al., *BMC Cell Biology.* 2008; 9:22, incorporated herein by reference); and ZO-2 bipartite NLS (RKSGKIAAIVVKRPRK (SEQ ID NO: 347), e.g., as described in Quiros et al., Nusrat A, ed. *Molecular Biology of the Cell.* 2013; 24(16):2528-2543, incorporated herein by reference).

The nucleotide sequence encoding an NLS is "operably linked" to the nucleotide sequence encoding a protein to which the NLS is fused (e.g., a Cas9 or a nucleobase editor) when two coding sequences are "in-frame with each other" and are translated as a single polypeptide fusing two sequences.

Nucleic acids of the present disclosure may include one or more genetic elements. A "genetic element" refers to a particular nucleotide sequence that has a role in nucleic acid expression (e.g., promoter, enhancer, terminator) or encodes a discrete product of an engineered nucleic acid (e.g., a nucleotide sequence encoding a guide RNA, a protein and/or an RNA interference molecule).

A "promoter" refers to a control region of a nucleic acid sequence at which initiation and rate of transcription of the remainder of a nucleic acid sequence are controlled. A promoter may also contain sub-regions at which regulatory proteins and molecules may bind, such as RNA polymerase and other transcription factors. Promoters may be constitutive, inducible, activatable, repressible, tissue-specific, or any combination thereof. A promoter drives expression or drives transcription of the nucleic acid sequence that it regulates. Herein, a promoter is considered to be "operably linked" when it is in a correct functional location and orientation in relation to a nucleic acid sequence it regulates to control ("drive") transcriptional initiation and/or expression of that sequence.

A promoter may be one naturally associated with a gene or sequence, as may be obtained by isolating the 5' non-coding sequences located upstream of the coding segment of a given gene or sequence. Such a promoter is referred to as an "endogenous promoter." In some embodiments, a coding nucleic acid sequence may be positioned under the control of a recombinant or heterologous promoter, which refers to a promoter that is not normally associated with the encoded sequence in its natural environment. Such promoters may include promoters of other genes; promoters isolated from any other cell; and synthetic promoters or enhancers that are not "naturally occurring" such as, for example, those that contain different elements of different transcriptional regulatory regions and/or mutations that alter expression through methods of genetic engineering that are known in the art. In addition to producing nucleic acid sequences of promoters and enhancers synthetically, sequences may be produced using recombinant cloning and/or nucleic acid amplification technology, including polymerase chain reaction (PCR).

In some embodiments, promoters used in accordance with the present disclosure are "inducible promoters," which are promoters that are characterized by regulating (e.g., initiating or activating) transcriptional activity when in the presence of, influenced by or contacted by an inducer signal. An inducer signal may be endogenous or a normally exogenous condition (e.g., light), compound (e.g., chemical or non-chemical compound) or protein that contacts an inducible promoter in such a way as to be active in regulating transcriptional activity from the inducible promoter. Thus, a "signal that regulates transcription" of a nucleic acid refers to an inducer signal that acts on an inducible promoter. A signal that regulates transcription may activate or inactivate transcription, depending on the regulatory system used. Activation of transcription may involve directly acting on a promoter to drive transcription or indirectly acting on a promoter by inactivation a repressor that is preventing the promoter from driving transcription. Conversely, deactivation of transcription may involve directly acting on a promoter to prevent transcription or indirectly acting on a promoter by activating a repressor that then acts on the promoter.

In genetics, a "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

A subject in need thereof" refers to an individual who has a disease, a sign and/or symptom of a disease, or a predisposition toward a disease, with the purpose to cure, heal, alleviate, relieve, alter, remedy, ameliorate, improve, or affect the disease, the symptom of the disease, or the predisposition toward the disease. In some embodiments, the subject is a mammal. In some embodiments, the subject is a non-human primate. In some embodiments, the subject is human. In some embodiments, the mammal is a rodent. In some embodiments, the rodent is a mouse. In some embodiments, the rodent is a rat. In some embodiments, the mammal is a companion animal. A "companion animal" refers to pets and other domestic animals. Non-limiting examples of companion animals include dogs and cats; livestock, such as horses, cattle, pigs, sheep, goats, and chickens; and other animals, such as mice, rats, guinea pigs, and hamsters.

The term "target site" refers to a sequence within a nucleic acid molecule that is edited by a base editor (BE) or nucleobase editor disclosed herein. The term "target site," in the context of a single strand, also can refer to the "target strand" which anneals or binds to the spacer sequence of the guide RNA. The target site can refer, in certain embodiments, to a segment of double-stranded DNA that includes the protospacer (i.e., the strand of the target site that has the same nucleotide sequence as the spacer sequence of the guide RNA) on the PAM-strand (or non-target strand) and target strand, which is complementary to the protospacer and the spacer alike, and which anneals to the spacer of the guide RNA, thereby targeting or programming a Cas9 nucleobase editor to target the target site.

A "transcriptional terminator" is a nucleic acid sequence that causes transcription to stop. A transcriptional terminator may be unidirectional or bidirectional. It is comprised of a DNA sequence involved in specific termination of an RNA transcript by an RNA polymerase. A transcriptional terminator sequence prevents transcriptional activation of downstream nucleic acid sequences by upstream promoters. A transcriptional terminator may be necessary in vivo to achieve desirable expression levels or to avoid transcription of certain sequences. A transcriptional terminator is considered to be "operably linked to" a nucleotide sequence when it is able to terminate the transcription of the sequence it is linked to.

The most commonly used type of terminator is a forward terminator. When placed downstream of a nucleic acid sequence that is usually transcribed, a forward transcriptional terminator will cause transcription to abort. In some embodiments, bidirectional transcriptional terminators are provided, which usually cause transcription to terminate on both the forward and reverse strand. In some embodiments, reverse transcriptional terminators are provided, which usually terminate transcription on the reverse strand only.

In prokaryotic systems, terminators usually fall into two categories (1) rho-independent terminators and (2) rho-dependent terminators. Rho-independent terminators are generally composed of palindromic sequence that forms a stem loop rich in G-C base pairs followed by several T bases. Without wishing to be bound by theory, the conventional model of transcriptional termination is that the stem loop causes RNA polymerase to pause, and transcription of the poly-A tail causes the RNA:DNA duplex to unwind and dissociate from RNA polymerase.

In eukaryotic systems, the terminator region may comprise specific DNA sequences that permit site-specific cleavage of the new transcript so as to expose a polyadenylation site. This signals a specialized endogenous polymerase to add a stretch of about 200 A residues (polyA) to the 3' end of the transcript. RNA molecules modified with this polyA tail appear to more stable and are translated more efficiently. Thus, in some embodiments involving eukaryotes, a terminator may comprise a signal for the cleavage of the RNA. In some embodiments, the terminator signal promotes polyadenylation of the message. The terminator and/or polyadenylation site elements may serve to enhance output nucleic acid levels and/or to minimize read through between nucleic acids.

Terminators for use in accordance with the present disclosure include any terminator of transcription described herein or known to one of ordinary skill in the art. Examples of terminators include, without limitation, the termination sequences of genes such as, for example, the bovine growth hormone terminator, and viral termination sequences such as, for example, the SV40 terminator, spy, yejM, secG-leuU, thrLABC, rrnB T1, hisLGDCBHAFI, metZWV, rrnC, xapR, aspA and arcA terminator. In some embodiments, the termination signal may be a sequence that cannot be transcribed or translated, such as those resulting from a sequence truncation.

A "Woodchuck Hepatitis Virus (WHP) Posttranscriptional Regulatory Element (WPRE)" is a DNA sequence that, when transcribed creates a tertiary structure enhancing expression. Commonly used in molecular biology to increase expression of genes delivered by viral vectors. WPRE is a tripartite regulatory element with gamma, alpha, and beta components.

The full WPRE sequence is 609 bp long:

```
                                         (SEQ ID NO: 376)
GCTTATCGATAATCAACCTCTGGATTACAAAATTTGTGAAAGATTGACTG

GTATTCTTAACTATGTTGCTCCTTTTACGCTATGTGGATACGCTGCTTTA

ATGCCTTTGTATCATGCTATTGCTTCCCGTATGGCTTTCATTTTCTCCTC

CTTGTATAAATCCTGGTTGCTGTCTCTTTATGAGGAGTTGTGGCCCGTTG

TCAGGCAACGTGGCGTGGTGTGCACTGTGTTTGCTGACGCAACCCCCACT

GGTTGGGGCATTGCCACCACCTGTCAGCTCCTTTCCGGGACTTTCGCTTT

CCCCCTCCCTATTGCCACGGCGGAACTCATCGCCGCCTGCCTTGCCCGCT

GCTGGACAGGGGCTCGGCTGTTGGGCACTGACAATTCCGTGGTGTTGTCG

GGGAAATCATCGTCCTTTCCTTGGCTGCTCGCCTATGTTGCCACCTGGAT

TCTGCGCGGGACGTCCTTCTGCTACGTCCCTTCGGCCCTCAATCCAGCGG

ACCTTCCTTCCCGCGGCCTGCTGCCGGCTCTGCGGCCTCTTCCGCGTCTT

CGCCTTCGCCCTCAGACGAGTCGGATCTCCCTTTGGGCCGCCTCCCCGCA

TCGATACCG.
```

The terms "nucleic acid," and "polynucleotide," as used herein, refer to a compound comprising a nucleobase and an acidic moiety, e.g., a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome (e.g., an engineered viral vector), an engineered vector, or fragment thereof, or a synthetic DNA, RNA, or DNA/RNA hybrid, optionally including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein is in a complex with, or is in association with, a nucleic acid, e.g., RNA or DNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* ($4^{th}$ ed., Cold Spring Harbor Laboratory Press, Cold Spring Harbor, N.Y. (2012)), which are incorporated herein by reference.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent (e.g., mouse, rat). In some embodiments, the subject is a domesticated animal. In some embodiments, the subject is a sheep, a goat, a cow, a cat, or a dog. In some embodiments, the subject is a research animal. In some embodiments, the subject is genetically engineered, e.g., a genetically engineered non-human subject. The subject may be of either sex and at any stage of development.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence. The fusion proteins (e.g., nucleobase editors) described herein are made by recombinant technology. Recombinant technology is familiar to those skilled in the art.

The term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

"A therapeutically effective amount" as used herein refers to the amount of each therapeutic agent (e.g., nucleobase editor, rAAV) described in the present disclosure required to confer therapeutic effect on the subject, either alone or in combination with one or more other therapeutic agents. Effective amounts vary, as recognized by those skilled in the art, depending on the particular condition being treated, the severity of the condition, the individual subject parameters including age, physical condition, size, gender, and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a subject may insist upon a lower dose or tolerable dose for medical reasons, psychological reasons or for virtually any other reasons. Empirical considerations, such as the half-life, generally will contribute to the determination of the dosage. For example, therapeutic agents that are compatible with the human immune system, such as polypeptides comprising regions from humanized antibodies or fully human antibodies, may be used to prolong half-life of the polypeptide and to prevent the polypeptide being attacked by the host's immune system.

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

As used herein, the term "variant" refers to a protein having characteristics that deviate from what occurs in nature that retains at least one functional i.e. binding, interaction, or enzymatic ability and/or therapeutic property thereof. A "variant" is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the wild type protein. For instance, a variant of Cas9 may comprise a Cas9 that has one or more changes in amino acid residues as compared to a wild type Cas9 amino acid sequence. As another example, a variant of a deaminase may comprise a deaminase that has one or more changes in amino acid residues as compared to a wild type deaminase amino acid sequence, e.g. following ancestral sequence reconstruction of the deaminase. These changes include chemical modifications, including substitutions of different amino acid residues truncations, covalent additions (e.g. of a tag), and any other mutations. The term also encompasses circular permutants, mutants, truncations, or domains of a reference sequence, and which display the same or substantially the same functional activity or activities as the reference sequence. This term also embraces fragments of a wild type protein.

The level or degree of which the property is retained may be reduced relative to the wild type protein but is typically the same or similar in kind. Generally, variants are overall very similar, and in many regions, identical to the amino acid sequence of the protein described herein. A skilled artisan will appreciate how to make and use variants that maintain all, or at least some, of a functional ability or property.

The variant proteins may comprise, or alternatively consist of, an amino acid sequence which is at least 80%, 85%, 90%, 95%, 96%, 97%, 98%, 99%, or 100%, identical to, for example, the amino acid sequence of a wild-type protein, or any protein provided herein.

By a polypeptide having an amino acid sequence at least, for example, 95% "identical" to a query amino acid sequence, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino- or carboxy-terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98%, or 99% identical to, for instance, the amino acid sequence of a protein such as a Niemann-Pick C1 (NPC1) protein, can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (*Comp. App. Biosci.* 6:237-245 (1990)). In a sequence alignment the query and subject sequences are either both nucleotide sequences or both amino acid sequences. The result of said global sequence alignment is expressed as percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

The term "vector," as used herein, refers to a nucleic acid that can be modified to encode a gene of interest and that is able to enter into a host cell and replicate within the host cell, and then transfer a replicated form of the vector into another host cell. Exemplary suitable vectors include viral vectors, such as AAV vectors or bacteriophages and filamentous phage, and conjugative plasmids. Additional suitable vectors will be apparent to those of skill in the art based on the instant disclosure.

As used herein the term "wild type" is a term of the art understood by skilled persons and means the typical form of an organism, strain, gene or characteristic as it occurs in nature as distinguished from mutant or variant forms.

DETAILED DESCRIPTION OF CERTAIN EMBODIMENTS

Provided herein are nucleic acid molecules (e.g., vector genomes), compositions (containing, e.g., vectors, recombinant viruses), rAAV particles, and kits comprising nucleic acids encoding split napDNAbp domains (e.g., Cas9 proteins) or nucleobase editors, and methods of delivering a nucleobase editor or a napDNAbp domain into a cell using such nucleic acids. The N-terminal portion and C-terminal portion of a nucleobase editor or a napDNAbp domain are encoded on separate nucleic acids and delivered into a cell, e.g., a via recombinant adeno-associated virus (rAAV particles) delivery. In particular embodiments, the N-terminal portion of a nucleobase editor is fused to a first intein, and the C-terminal portion of a nucleobase editor is fused to an intein. The N-terminal and C-terminal portions may each be encoded on separate nucleic acids and delivered into a cell, e.g., a via rAAV particle delivery. The polypeptides corresponding to the N-terminal portion and C-terminal portion of the base editor (or nucleobase editor) may be joined to form a complete nucleobase editor or Cas9 protein, e.g., via intein-mediated protein splicing.

To overcome the packaging size limit and deliver base editors using AAVs, a split-base editor dual AAV strategy was devised, in which the CBE or ABE is divided into an N-terminal portion (or "half") and a C-terminal half. Each base editor half is fused to half of a fast-splicing split-intein. Following co-infection by AAV particles expressing each base editor-split intein half, protein splicing in trans reconstitutes the full-length base editor. Unlike other approaches utilizing small molecules or sgRNA to bridge split Cas9, intein splicing removes all exogenous sequences and regenerates a native peptide bond at the split site, resulting in a single reconstituted protein (e.g., a protein that is identical in sequence to the unmodified nucleobase editor).

Split-intein CBEs and split-intein ABEs are disclosed that are integrated into dual AAV genomes to enable efficient base editing in somatic tissues of therapeutic relevance, including liver, heart, muscle, retina, and brain. The resulting AAVs were used to achieve base editing efficiencies at test loci for both CBEs and ABEs that, in each of these tissues, meets or exceeds therapeutically relevant editing thresholds for the treatment of human genetic diseases at AAV dosages that are known to be well-tolerated in humans. In particular, the disclosed AAV-nucleobase editor vectors achieved editing efficiencies of 59% editing (A·T-to-G·C) among unsorted cells in the cortex, and 48-50% editing (C·G-to-T·A) in photoreceptor cells and mouse embryonic fibroblasts (MEFs). The highest in vivo genome editing efficiencies were observed following injection of ~$10^{13}$-$10^{14}$ vector genomes per kilogram weight of subject (vgs/kg), which is a dosage comparable to those currently used in human gene therapy trials. Accordingly, the invention provides split napDNAbp domains (e.g., Cas9 proteins), split nucleobase editors, and nucleic acids and vectors encoding same; as well as cells, compositions, methods, kits, and systems that utilize the disclosed split napDNAbp domains, split nucleobase editors, and vectors.

Aspects of the present disclosure relate to nucleic acid molecules encoding a N-terminal portion of a base editor or nucleobase editor fused at its C-terminus to a first intein sequence, wherein the nucleic acid molecule is operably linked to a first promoter, further comprising a nucleic acid segment encoding a guide RNA (gRNA) operably linked to a second promoter, wherein the direction of transcription of the nucleic acid segment is reversed relative to the direction of transcription of the nucleic acid molecule. These nucleic acid molecules may be comprised within a viral genome, such as an rAAV genome or rAAV vector.

Further provided are nucleic acid molecules encoding a C-terminal portion of a nucleobase editor fused at its N-terminus to an intein sequence, wherein the nucleic acid molecule is operably linked to a first promoter, and further comprising a nucleic acid segment encoding a guide RNA (gRNA) operably linked to a second promoter, wherein the direction of transcription of the nucleic acid segment is reversed relative to the direction of transcription of the nucleic acid molecule. In some embodiments, the first promoter of the nucleic acid molecule encoding the N-terminal portion of the nucleobase editor and the first promoter of the nucleic acid molecule encoding the C-terminal portion of the nucleobase editor comprise the same promoter (i.e., are the same). In other embodiments, these first promoters are different. In some embodiments, the second promoter of the nucleic acid molecule encoding the N-terminal portion of the nucleobase editor and the second promoter of the nucleic acid molecule encoding the C-terminal portion of the nucleobase editor are the same. In other embodiments, these second promoters are different.

Some aspects of the present disclosure relate to compositions comprising (i) a first nucleotide sequence encoding an N-terminal portion of a Cas9 protein fused at its C-terminus to an intein-N; and (ii) a second nucleotide sequence encoding an intein-C fused to the N-terminus of a C-terminal portion of the Cas9 protein, wherein at least one of the first nucleotide sequence and second nucleotide sequence comprises at its 3' end a gRNA nucleic acid segment encoding a guide RNA (gRNA) operably linked to a second promoter, and wherein the direction of transcription of the gRNA nucleic acid segment is reversed relative to the direction of transcription of the at least one nucleotide sequence. In some embodiments, the first nucleotide sequence and/or second nucleotide sequence is operably linked to a nucleotide sequence encoding at least one bipartite nuclear localization signal (NLS).

Additional aspects of the present disclosure relate to methods of editing using the split nucleobase editors and/or the split Cas9 proteins disclosed herein. In particular embodiments, provided herein are methods of base editing at therapeutically-relevant efficiencies in vivo, such as in murine retina. The methods disclosed herein improve the rate and throughput with which promising base editor targets can be identified in cultured cells and in vivo.

This disclosure describes methods of base editing that may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases and conditions can be treated by making an A to G, or a C to T mutation, may be treated using the base editors provided herein. The base editors described herein may be utilized for the targeted editing of C to T and G to A mutations so as to correct a mutation or restore a normal reading frame in an gene to generate a functional protein. In certain embodiments, the subject has been diagnosed with a disease, disorder, or condition, such as, but not limited to, a disease, disorder, or condition associated with a point mutation in the Tmc1 gene or the NPC1 gene. The methods described herein involving contacting a base editor with a target nucleotide sequence in the genome of an organism, e.g., a human.

In certain embodiments, the methods described above result in cutting (or nicking) one strand of the double-stranded DNA, for example, the strand that includes the thymine (T) of a target A:T nucleobase pair opposite the strand containing the target adenine (A) that is being deaminated. This nicking result serves to direct mismatch repair machinery to the non-edited strand, ensuring that the chemically modified nucleobase is not interpreted as a lesion by the machinery. This nick may be created by the use of an nCas9.

Still further, the present disclosure provides for methods of making the disclosed split nucleobase editors, as well as methods of using the split nucleobase editors or nucleic acid molecules encoding the nucleobase editors in applications including editing a nucleic acid molecule, e.g., a genome. Such methods involve transducing (e.g., via transfection) cells with a plurality of complexes each comprising a portion of a split nucleobase editor (e.g., a nucleobase editor comprising a napDNAbp (e.g., nCas9) domain and a deaminase domain) and/or a gRNA molecule. In some embodiments, the nucleic acid constructs encoding the N-terminal and C-terminal portions of the split nucleobase editor are transfected separately from one another. In certain embodiments, the methods involve the transfection of nucleic acid constructs (e.g., plasmids) that each (or together) encode the components of a complex of split nucleobase editor and a gRNA molecule.

In certain embodiments of the disclosed methods of making the disclosed split nucleobase editors, one or more nucleic acid constructs that encode the split nucleobase editor is transfected into the cell separately from the plasmid that encodes the gRNA molecule. In certain embodiments, these components are encoded on a single construct and transfected together. In other embodiments, the methods disclosed herein involve the introduction into cells of one or more nucleic acid vectors encoding a a split nucleobase editor and gRNA molecule that has been expressed and cloned outside of these cells. In some embodiments, these vectors are delivered as part of an rAAV vector.

It should be appreciated that any nucleobase editor, e.g., any of the nucleobase editors provided herein, may be introduced into the cell in any suitable way, either stably or transiently. In some embodiments, a nucleobase editor may be transfected into the cell. In some embodiments, the cell may be transduced or transfected with a nucleic acid construct that encodes a nucleobase editor. For example, a cell may be transduced (e.g., with a virus encoding a nucleobase editor), or transfected (e.g., with a plasmid encoding a nucleobase editor) with a nucleic acid that encodes a nucleobase editor, or the translated nucleobase editor. Such transduction may be a stable or transient transduction. In some embodiments, cells expressing a nucleobase editor or containing a nucleobase editor may be transduced or transfected with one or more gRNA molecules, for example, when the nucleobase editor comprises a Cas9 (e.g., nCas9) domain. In some embodiments, a plasmid expressing one or more portions of a nucleobase editor may be introduced into cells through electroporation, transient (e.g., lipofection) and stable genome integration (e.g., nucleofection and piggybac), viral transduction, or other methods known to those of skill in the art. In particular embodiments, plasmids expressing one or more portions of any of the disclosed nucleobase editors may be delivered to cells through nucleofection.

In some aspects, the disclosed split nucleobase editors are delivered to the cell (or the subject) by use of recombinant AAV (rAAV) particles. In some embodiments, any of the disclosed split nucleobase editors is fused to split intein pairs that are packaged into two separate rAAV particles that, when co-delivered to a cell, reconstitute the functional editor protein. Several other considerations to account for the unique features of base editing are described, including the optimization of second-site nicking targets and properly packaging nucleobase editors into virus vectors, including lentiviruses and rAAV. Accordingly, the disclosure provides dual rAAV vectors and dual rAAV vector particles that comprise expression constructs that encode two portions (or "two halves") of any of the disclosed nucleobase editors, wherein the encoded nucleobase editor is divided between the two halves at a split site. In some embodiments, the disclosed rAAV vectors encoding the split nucleobase editors may comprise a nucleotide sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the sequences depicted in FIGS. 26A-26U.

Accordingly, the present disclosure provides compositions comprising: (i) a first recombinant adeno associated virus (rAAV) particle comprising a first nucleotide sequence encoding a N-terminal portion of a Cas9 protein fused at its C-terminus to an intein-N; and (ii) a second recombinant adeno associated virus (rAAV) particle comprising a second nucleotide sequence encoding an intein-C fused to the N-terminus of a C-terminal portion of the Cas9 protein. In some embodiments, at least one of the first nucleotide sequence and second nucleotide sequence comprises at its 3' end a gRNA nucleic acid segment encoding a guide RNA (gRNA) operably linked to a second promoter, and wherein the direction of transcription of the gRNA nucleic acid segment is reversed relative to the direction of transcription of the at least one nucleotide sequence.

In some aspects, the specification discloses a pharmaceutical composition comprising any one of the presently disclosed complexes of nucleobase editors and gRNA. In other aspects, the present disclosure discloses a pharmaceutical composition comprising one or more polynucleotides encoding the nucleobase editors disclosed herein and one or more polynucleotides encoding a gRNA, or polynucleotides encoding both. The one or more polynucleotides encoding the nucleobase editors and one or moe polynucleotides encoding a gRNA may be provided on the same vector, or different vectors (e.g., different rAAV vectors).

napDNAbp Domains

In some aspects, the base editing methods and nucleobase editors described herein involve a nucleic acid programmable DNA binding protein (napDNAbp). Each napDNAbp is associated with at least one guide nucleic acid (e.g., guide RNA), which localizes the napDNAbp to a DNA sequence that comprises a DNA strand (i.e., a target strand) that is complementary to the guide nucleic acid, or a portion thereof (e.g., the protospacer of a guide RNA). In other words, the guide nucleic-acid "programs" the napDNAbp (e.g., Cas9 or equivalent) to localize and bind to a complementary sequence. In various embodiments, the napDNAbp can be fused to a disclosed herein adenosine deaminase or a herein disclosed cytosine deaminase. In other aspects, the napDNAbp can be fused to a non-deaminase nucleobase modifying enzyme (or nucleobase modification domain) disclosed herein.

Without being bound by theory, the binding mechanism of a napDNAbp—guide RNA complex, in general, includes the step of forming an R-loop whereby the napDNAbp induces the unwinding of a double-strand DNA target, thereby separating the strands in the region bound by the napDNAbp. The guide RNA spacer then hybridizes to the "target strand." This displaces a "non-target strand" that is complementary to the target strand, which forms the single strand region of the R-loop. In some embodiments, the napDNAbp includes one or more nuclease activities, which then cut the DNA leaving various types of lesions. For example, the napDNAbp may comprises a nuclease activity that cuts the non-target strand at a first location, and/or cuts the target strand at a second location. Depending on the nuclease activity, the target DNA can be cut to form a "double-stranded break" whereby both strands are cut. In other embodiments, the target DNA can be cut at only a single site, i.e., the DNA is "nicked" on one strand. Exemplary napDNAbp with different nuclease activities include "Cas9 nickase" ("nCas9") and a deactivated Cas9 having no nuclease activities ("dead Cas9" or "dCas9").

The below description of various napDNAbps which can be used in connection with the presently disclose nucleobase editors is not meant to be limiting in any way. The nucleobase editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 variants have a nickase activity, i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats). The nucleobase editors described herein may also comprise Cas9 equivalents, including Cas12a/Cpf1 and Cas12b proteins which are the result of convergent evolution. The napDNAbps used herein (e.g., SpCas9, Cas9 variant, or Cas9 equivalents) may also may also contain various modifications that alter/enhance their PAM specificities. Lastly, the application contemplates any Cas9, Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequence or a reference Cas9 equivalent (e.g., Cas12a/Cpf1).

The napDNAbp can be a CRISPR (clustered regularly interspaced short palindromic repeat)-associated nuclease. As outlined above, CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M. et al., *Science* 337:816-821(2012), the entire contents of which is hereby incorporated by reference.

In some embodiments, the napDNAbp directs cleavage of one or both strands at the location of a target sequence, such as within the target sequence and/or within the complement of the target sequence. In some embodiments, the napDNAbp directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a napDNAbp that is mutated to with respect to a corresponding wild-type enzyme such that the mutated napDNAbp lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A in reference to the canonical SpCas9 sequence, or to equivalent amino acid positions in other Cas9 variants or Cas9 equivalents.

As used herein, the term "Cas protein" refers to a full-length Cas protein obtained from nature, a recombinant Cas protein having a sequences that differs from a naturally occurring Cas protein, or any fragment of a Cas protein that nevertheless retains all or a significant amount of the requisite basic functions needed for the disclosed methods, i.e., (i) possession of nucleic-acid programmable binding of the Cas protein to a target DNA, and (ii) ability to nick the target DNA sequence on one strand. The Cas proteins contemplated herein embrace CRISPR Cas 9 proteins, as well as Cas9 equivalents, variants (e.g., Cas9 nickase (nCas9) or nuclease inactive Cas9 (dCas9)) homologs, orthologs, or paralogs, whether naturally occurring or non-naturally occurring (e.g., engineered or recombinant), and may include a Cas9 equivalent from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," *Science* 2016; 353(6299), the contents of which are incorporated herein by reference.

The terms "Cas9" or "Cas9 nuclease" or "Cas9 moiety" or "Cas9 domain" embrace any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. The term Cas9 is not meant to be particularly limiting and may be referred to as a "Cas9 or equivalent." Exemplary Cas9 proteins are further described herein and/or are described in the art and are incorporated herein by reference. The present disclosure is unlimited with regard to the particular Cas9 that is employed in the nucleobase editor (BE) of the invention.

As noted herein, Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., *Proc. Natl. Acad. Sci. U.S.A.* 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., *Nature* 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference).

The Cas9 protein encoded by the first and second nucleotide sequence is herein referred as a "split Cas9." The Cas9 protein is known to have an N-terminal lobe and a C-terminal lobe linked by a disordered linker (e.g., as described in Nishimasu et al., Cell, Volume 156, Issue 5, pp. 935-949, 2014, incorporated herein by reference). In some embodiments, the N-terminal portion of the split Cas9 protein comprises the N-terminal lobe of a Cas9 protein. In some embodiments, the C-terminal portion of the split Cas9 comprises the C-terminal lobe of a Cas9 protein.

In some embodiments, the N-terminal portion of the split Cas9 comprises a portion of any one of SEQ ID NO: 1-129, 143-275, 282-291, 394-397, 435-437, 519-549, and 554-556 that corresponds to amino acids 1-(550-650) in SEQ ID NO: 1. "1-(550-650)" means starting from amino acid 1 and ending anywhere between amino acid 550-650 (inclusive). For example, the N-terminal portion of the split Cas9 may comprise a portion of any one of SEQ ID NOs: 1-129, 143-275, 282-291, 394-397, 435-437, 519-549, and 554-556 that corresponds to amino acids 1-550, 1-551, 1-552, 1-553, 1-554, 1-555, 1-556, 1-557, 1-558, 1-559, 1-560, 1-561, 1-562, 1-563, 1-564, 1-565, 1-566, 1-567, 1-568, 1-569, 1-570, 1-571, 1-572, 1-573, 1-574, 1-575, 1-576, 1-577, 1-578, 1-579, 1-580, 1-581, 1-582, 1-583, 1-584, 1-585, 1-586, 1-587, 1-588, 1-589, 1-590, 1-591, 1-592, 1-593, 1-594, 1-595, 1-596, 1-597, 1-598, 1-599, 1-600, 1-601, 1-602, 1-603, 1-604, 1-605, 1-606, 1-607, 1-608, 1-609, 1-610, 1-611, 1-612, 1-613, 1-614, 1-615, 1-616, 1-617, 1-618, 1-619, 1-620, 1-621, 1-622, 1-623, 1-624, 1-625, 1-626, 1-627, 1-628, 1-629, 1-630, 1-631, 1-632, 1-633, 1-634, 1-635, 1-636, 1-637, 1-638, 1-639, 1-640, 1-641, 1-642, 1-643, 1-644, 1-645, 1-646, 1-647, 1-648, 1-649, or 1-650 of SEQ ID NO: 1. In some embodiments, the N-terminal portion of the split Cas9 protein comprises a portion of any one of SEQ ID NOs: 1-129, 143-275, 282-291, 394-397, 435-437, 519-549, and 554-556 that corresponds to amino acids 1-573 or 1-637 of SEQ ID NO: 1.

In some embodiments, the N-terminal portion of the split Cas9 may comprise a portion of any one of SEQ ID NOs: 1-129, 143-275, 282-291, 394-397, 435-437, 519-549, and 554-556 that corresponds to amino acids 1-430, 1-431, 1-432, 1-433, 1-434, 1-435, 1-436, 1-437, 1-438, 1-439, 1-440, 1-441, 1-442, 1-443, 1-444, 1-445, 1-446, 1-447, 1-448, 1-449, 1-450, 1-451, 1-452, 1-453, 1-454, 1-455, 1-456, 1-457, 1-458, 1-459, 1-460, 1-461, 1-462, 1-463, 1-464, 1-465, 1-466, 1-467, 1-468, 1-469, 1-470, 1-471, 1-472, 1-473, 1-474, 1-475, 1-476, 1-477, 1-478, 1-479, 1-480, 1-481, 1-482, 1-483, 1-484, 1-485, 1-486, 1-487, 1-488, 1-489, 1-490, 1-491, 1-492, 1-493, 1-494, 1-495, 1-496, 1-497, 1-498, 1-499, 1-500, 1-501, 1-502, 1-503, 1-504, 1-505, 1-506, 1-507, 1-508, 1-509, 1-510, 1-511, 1-512, 1-513, 1-514, 1-515, 1-516, 1-517, 1-518, 1-519, 1-520, 1-521, 1-522, 1-523, 1-524, 1-525, 1-526, 1-527, 1-528, 1-529, 1-530, 1-531, 1-532, 1-533, 1-534, 1-535, 1-536, 1-537, 1-538, or 1-539 of SEQ ID NO: 11. In some embodiments, the N-terminal portion of the split Cas9 protein comprises a portion of any one of SEQ ID NOs: 1-129, 143-275, 282-291, 394-397, 435-437, 519-549, and 554-556 that corresponds to amino acids 1-431, 1-453, 1-457, 1-484, 1-501, 1-534, or 1-537 of SEQ ID NO: 11. In certain embodiments, the N-terminal portion of the split Cas9 protein comprises a portion of any one of SEQ ID NOs: 1-129, 143-275, 282-291, 394-397, 435-437, 519-549, and 554-556 that corresponds to amino acids 1-534 of SEQ ID NO: 11.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of any one of SEQ ID NO: 1-129, 143-275, 282-291, 394-397, 435-437, 519-549, and 554-556 that corresponds to amino acids (551-651)-1368 of SEQ ID NO: 1. "(551-651)-1368" means starting at an amino acid between amino acids 551-651 (inclusive) and ending at amino acid 1368.

For example, the C-terminal portion of the split Cas9 may comprise a portion of any one of SEQ ID NO: 1-129, 143-275, 282-291, 394-397, 435-437, 519-549, and 554-556 that corresponds to amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of SEQ ID NO: 1. In some embodiments, the C-terminal portion of the split Cas9 protein comprises a portion of any one of SEQ ID NO: 1-129, 143-275, 282-291, 394-397, 435-437, 519-549, and 554-556 that corresponds to amino acids 574-1368 or 638-1368 of SEQ ID NO: 1.

In other embodiments, the C-terminal portion of the split Cas9 protein comprises a portion of any one of SEQ ID NO: 1-129, 143-275, 282-291, 394-397, 435-437, 519-549, and 554-556 that corresponds to amino acids 432-1054, 454-1054, 458-1054, 485-1054, 502-1054, 535-1054, or 538-1054 of SEQ ID NO: 11. In certain embodiments, the C-terminal portion of the split Cas9 protein comprises a portion of any one of SEQ ID NO: 1-129, 143-275, 282-291, 394-397, 435-437, 519-549, and 554-556 that corresponds to amino acids 535-1054 of SEQ ID NO: 11.

In other embodiments, the C-terminal portion of the split Cas9 protein comprises a portion of any one of SEQ ID NO: 1-129, 143-275, 282-291, 394-397, 435-437, 519-549, and 554-556 that corresponds to amino acids 432-1054, 454-1054, 458-1054, 485-1054, 502-1054, 535-1054, or 538-1054 of SEQ ID NO: 10. In certain embodiments, the C-terminal portion of the split Cas9 protein comprises a portion of any one of SEQ ID NO: 1-129, 143-275, 282-291, 394-397, 435-437, 519-549, and 554-556 that corresponds to amino acids 535-1054 of SEQ ID NO: 10.

Further aspects of the present disclosure provide rAAV particles comprising a first nucleic acid molecule (e.g. encoding a N-terminal portion of a nucleobase editor or Cas9 protein fused at its C-terminus to an intein-N) as described herein. rAAV particles comprising a second nucleic acid molecule (e.g. encoding an intein-C fused to the N-terminus of a C-terminal portion of the Cas9 protein or nucleobase editor) as described herein are also provided. The disclosed rAAV particles may comprise both a first nucleic acid molecule and second nucleic acid molecules as described herein.

Cas9 variants may also be delivered to cells using the methods described herein. For example, a Cas9 variant may also be "split" as described herein. A Cas9 variant may comprise an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 sequences provided herein. In some embodiments, the Cas9 variant comprises an amino acid sequence that is shorter or longer in length (e.g., by no more than 30%, no more than 25%, no more than 20%, no more than 15%, no more than 10%, no more than 5%, no more than 1% longer or shorter) than any of the Cas9 proteins provided herein (e.g., a *S. pyogenes* Cas9 (SpCas9) (SEQ ID NO: 1), *S. pyogenes* Cas9 nickase (SpCas9n) (SEQ ID NO: 3), *S. aureus* Cas9 (SaCas9) (SEQ ID NO: 10), and *S. aureus* Cas9 nickase (SaCas9) (SEQ ID NO: 11). In some embodiments, the Cas9 variant comprises an amino acid sequence that is shorter or longer in length (e.g., by no more than 200 amino acids, no more than 150 amino acids, no more than 100 amino acids, no more than 50 amino acids, no more than 10 amino acids, no more than 5 amino acids, or no more than 2 amino acids longer or shorter) than any of the Cas9 proteins provided herein.

In some embodiments, the N-terminal portion of a split Cas9 comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the corresponding portion of any one of the Cas9 sequences provided herein (e.g., a SpCas9, SpCas9n, SaCas9, or SaCas9n). In some embodiments, the N-terminal portion of the split Cas9 comprises an amino acid sequence that is shorter or longer in length (e.g., by no more than 30%, no more than 25%, no more than 20%, no more than 15%, no more than 10%, no more than 5%, no more than 1% longer or shorter) than the corresponding portion of any of the Cas9 proteins provided herein. In some embodiments, the N-terminal portion of the split Cas9 comprises an amino acid sequence that is shorter or longer in length (e.g., by no more than 200 amino acids, no more than 150 amino acids, no more than 100 amino acids, no more than 50 amino acids, no more than 10 amino acids, no more than 5 amino acids, or no more than 2 amino acids longer or shorter) than the corresponding portion of any of the Cas9 proteins provided herein.

In some embodiments, the C-terminal portion of a split Cas9 comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the corresponding portion of any one of the Cas9 sequences provided herein (e.g., the Cas9 sequences of any of SEQ ID NOs: 1, 3, 10, and 11). In some embodiments, the C-terminal portion of the split Cas9 comprises an amino acid sequence that is shorter or longer in length (e.g., by no more than 30%, no more than 25%, no more than 20%, no more than 15%, no more than 10%, no more than 5%, no more than 1% longer or shorter) than the corresponding portion of any of the Cas9 proteins provided herein. In some embodiments, the C-terminal portion of the split Cas9 comprises an amino acid sequence that is shorter or longer in length (e.g., by no more than 200 amino acids, no more than 150 amino acids, no more than 100 amino acids, no more than 50 amino acids, no more than 10 amino acids, no more than 5 amino acids, or no more than 2 amino acids longer or shorter) than the corresponding portion of any of the Cas9 proteins provided herein.

In some embodiments, the Cas9 variant is a dCas9 or nCas9. In some embodiments, the Cas9 protein is selected from *S. pyogenes* Cas9 (SpCas9) (SEQ ID NO: 1), *S. pyogenes* Cas9 nickase (SEQ ID NO: 3), *S. aureus* Cas9 (SaCas9) (SEQ ID NO: 10), and *S. aureus* Cas9 nickase (SEQ ID NO: 11). In certain embodiments, the Cas9 variant is a VRQR variant of SpCas9 that is compatible with NGA PAM sites.

Accordingly, in some embodiments, the N-terminal portion of the Cas9 protein comprises a portion of any one of SEQ ID NOs: 1-129, 143-275, 282-291, 394-397, 435-437, 519-549, and 554-556 that corresponds to amino acids 1-573 or 1-637 of SEQ ID NO: 1. In some embodiments, the C-terminal portion of the Cas9 protein comprises a portion of any one of SEQ ID NOs: 1-129, 143-275, 282-291, 394-397, 435-437, 519-549, and 554-556 that corresponds to amino acids 574-1368 or 638-1368 of SEQ ID NO: 1. In other embodiments, the N-terminal portion of the Cas9 protein comprises a portion of any one of SEQ ID NOs: 1-129, 143-275, 282-291, 394-397, 435-437, 519-549, and 554-556 that corresponds to amino acids 1-573 or 1-637 of SEQ ID NO: 3. In some embodiments, the C-terminal portion of the Cas9 protein comprises a portion of any one of SEQ ID NOs: 1-129, 143-275, 282-291, 394-397, 435-437, 519-549, and 554-556 that corresponds to amino acids 574-1368 or 638-1368 of SEQ ID NO: 3.

In some embodiments, the N-terminal portion of the Cas9 protein comprises a portion of any one of SEQ ID NOs: 1-129, 143-275, 282-291, 394-397, 435-437, 519-549, and 554-556 that corresponds to amino acids 1-534 of SEQ ID NO: 11. In some embodiments, the C-terminal portion of the Cas9 protein comprises a portion of any one of SEQ ID NOs: 1-129, 143-275, 282-291, 394-397, 435-437, 519-549, and 554-556 that corresponds to amino acids 535-1054 of SEQ ID NO: 11.

In some embodiments, the N-terminal portion of the split Cas9 comprises a mutation corresponding to a D10A mutation in SEQ ID NO: 1. In some embodiments, the N-terminal portion of the split Cas9 comprises a mutation corresponding to a D10A mutation in SEQ ID NO: 1 and the C-terminal portion of the split Cas9 comprises a mutation corresponding to a H840A mutation in SEQ ID NO:1. In some embodiments, the N-terminal portion of the split Cas9 comprises a mutation corresponding to a D10A mutation in SEQ ID NO: 1, and the C-terminal portion of the split Cas9 comprises a histidine at the position corresponding to position 840 in SEQ ID NO:1.

In other embodiments, the N-terminal portion of the split Cas9 comprises a mutation corresponding to a D10A mutation in SEQ ID NO: 10.

In some embodiments, to join the N-terminal portion of the Cas9 protein and the C-terminal portion of the Cas9 protein, an intein system may be used. In some embodiments, the N-terminal portion of the Cas9 is fused to an intein-N. In some embodiments, the intein-N is fused to the C-terminus of the N-terminal portion of the Cas9 to form a structure of $NH_2$-[N-terminal portion of Cas9]-[intein-N]-COOH. In some embodiments, the intein-N is encoded by the dnaE-n gene. In some embodiments, the intein-N comprises the amino acid sequence as set forth in SEQ ID NO: 351 or 355. In some embodiments, the C-terminal portion of the Cas9 is fused to an intein-C, and the intein-C is fused to the N-terminus of the C-terminal portion of the Cas9 to form a structure of $NH_2$-[intein-C]-[C-terminal portion of Cas9]-COOH. In some embodiments, the intein-C is encoded by the dnaE-c gene. In some embodiments, the intein-C comprises the amino acid sequence as set forth in SEQ ID NO: 353 or 357.

Other split intein systems may also be used in the present disclosure and are known in the art. For example, in some embodiments, the intein pair comprises an Npu split intein. In certain such embodiments, the intein-N comprises the amino acid sequence of SEQ ID NO: 351. In some embodiments, the intein-C comprises the amino acid sequence of SEQ ID NO: 353.

As described herein, the N-terminal portion of a nucleobase editor comprises the N-terminal portion of a nuclease-inactive Cas9 protein (dCas9) or a Cas9 nickase (nCas9). In some embodiments, the N-terminal portion of a nucleobase editor further comprises a nucleobase modifying enzyme (e.g., nucleases, nickases, recombinases, deaminases, DNA repair enzymes, DNA damage enzymes, dismutases, alkylation enzymes, depurination enzymes, oxidation enzymes, pyrimidine dimer forming enzymes, integrases, transposases, polymerases, ligases, helicases, photolyases, glycosylases, epigenetic modifiers such as methylases, acetylases, methyltransferase, demethylase, etc.). In some embodiments, the nucleobase modifying enzyme is a deaminase (e.g., a cytosine deaminase or an adenosine deaminase, or functional variants thereof). In some embodiments, the nucleobase modifying enzyme is fused to the N-terminus of the N-terminal portion of the split dCas9 or split nCas9. In some embodiments, the N-terminal portion of the nucleobase editor has of the structure: $NH_2$-[nucleobase modifying enzyme]-[N-terminal portion of dCas9 or nCas9]-COOH. In some embodiments, the N-terminal portion of the nucleobase editor is fused to an intein N. In some embodiments, the intein-N is fused to the C-terminus of the N-terminal portion of the nucleobase editor.

In some embodiments, the first nucleotide sequence encodes a polypeptide comprising the structure $NH_2$-[nucleobase modifying enzyme]-[N-terminal portion of dCas9 or nCas9]-[intein-N]-COOH.

In some embodiments, the C-terminal portion of the nucleobase editor comprises the C-terminal portion of a nuclease-inactive Cas9 protein (dCas9) or a Cas9 nickase (nCas9). In some embodiments, the nucleobase modifying enzyme is fused to the C-terminus of the C-terminal portion of the split dCas9 or split nCas9. In some embodiments, the C-terminal portion of the nucleobase editor is of the structure: $NH_2$-[C-terminal portion of dCas9 or nCas9]-[nucleobase modifying enzyme]-COOH. In some embodiments, the C-terminal portion of the nucleobase editor comprises an intein-C fused to the C-terminal portion of the Cas9 protein. In some embodiments, the intein-C is fused to the N-terminus of the C-terminal portion of the nucleobase editor. In some embodiments, the second nucleotide sequence encodes a polypeptide of the structure: $NH_2$-[intein-C]-[C-terminal portion of the Cas9 protein]-COOH.

Non-limiting examples of suitable Cas9 proteins and variants, and nucleobase editors and variants are provided. The disclosure provides Cas9 variants, for example, Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 1, or a corresponding mutation in any of the amino acid sequences provided in SEQ ID NOs: 2-275, 394-397 and 488, are mutated. In some embodiments, the D10 residue of the amino acid sequence provided in SEQ ID NO: 1, or a corresponding mutation in any of the amino acid sequences provided in SEQ ID NOs: 2-275, 394-397 and 488, is mutated to any amino acid residue, except for D. In some embodiments, the D10 residue of the amino acid sequence provided in SEQ ID NO: 1, or a corresponding mutation in any of the amino acid sequences provided in SEQ ID NOs: 2-275, 394-397 and 488, is mutated to an A. In some embodiments, the H840 residue of the amino acid sequence provided in SEQ ID NO: 1, or a corresponding residue in any of the amino acid sequences provided in SEQ ID NOs: 2-275, 394-397 and 488, is an H. In some embodiments, the H840 residue of the amino acid sequence provided in SEQ ID NO: 1, or a corresponding mutation in any of the amino acid sequences provided in SEQ ID NOs: 2-275, 394-397 and 488, is mutated to any amino acid residue, except for H. In some embodiments, the H840 residue of the amino acid sequence provided in SEQ ID NO: 1, or a corresponding mutation in any of the amino acid sequences provided in SEQ ID NOs: 2-275, 394-397 and 488, is mutated to an A. In some embodiments, the D10 residue of the amino acid sequence provided in SEQ ID NO: 1, or a corresponding residue in any of the amino acid sequences provided in SEQ ID NOs: 2-275, 394-397 and 488, is a D.

A number of Cas9 sequences from various species were aligned to determine whether corresponding homologous amino acid residues of D10 and H840 of SEQ ID NO: 1 can be identified in other Cas9 proteins, allowing the generation of Cas9 variants with corresponding mutations of the homologous amino acid residues. The alignment was carried out using the NCBI Constraint-based Multiple Alignment Tool (COBALT (accessible at st-va.ncbi.nlm.nih.gov/tools/cobalt)), with the following parameters. Alignment parameters: Gap penalties −11, −1; End-Gap penalties −5, −1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

Examples of Cas9 and Cas9 equivalents are provided as follows; however, these specific examples are not meant to be limiting. The nucleobase editor fusions of the present disclosure may use any suitable napDNAbp, including any suitable Cas9 or Cas9 equivalent.

*S. pyogenes* Cas9 wild type
(NCBI Reference Sequence: NC 002737.2, Uniprot Reference Sequence: Q99ZW2)
(SEQ ID NO: 1)

MDKKYSIGLDIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKRYTSTKEVLDATLIHQSITGLYETRIDLSQLGGD

-continued

*S. pyogenes* dCas9 (D10A and H840A)

(SEQ ID NO: 2)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDAIVPQSFLKDDSIDNKVLTRSDKNRGKSDNVPSLEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKRYTSTKEVLDATLIHQSITGLYETRIDLSQLGGD

*S. pyogenes* Cas9 Nickase (D10A)

(SEQ ID NO: 3)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

-continued

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKRYTSTKEVLDATLIHQSITGLYETRIDLSQLGGD

VRER-nCas9 (D10A/D1135V/G1218R/R1335E/T1337R) *S. pyogenes* Cas9 Nickase
(SEQ ID NO: 4)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEKGKSKKLKSVKELLGITIME

RSSFEKNPIDFLEAKGYKEVKKDLIIKLPKYSLFELENGRKRMLASARELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKEYRSTKEVLDATLIHQSITGLYETRIDLSQLGGD

VQR-nCas9 (D10A/D1135V/R1335Q/T1337R) *S. pyogenes* Cas9 Nickase
(SEQ ID NO: 5)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEKGKSKKLKSVKELLGITIME

-continued

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKQYRSTKEVLDATLIHQSITGLYETRIDLSQLGGD

EQR-nCas9 (D10A/D1135E/R1335Q/T1337R) *S. pyogenes* Cas9 Nickase (SEQ ID NO: 6)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKQYRSTKEVLDATLIHQSITGLYETRIDLSQLGGD

VRQR-nCas9 (D10A/D1135V/G1218R/R1335Q/T1337R) *S. pyogenes* Cas9
Nickase (SEQ ID NO: 488)

MDKKYSIGLAIGTNSVGWAVITDEYKVPSKKFKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLLKALVRQQLPEK

YKEIFFDQSKNGYAGYIDGGASQLEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGA

SAQSFIERMTNFDKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKA

-continued

TAKYFFYSNIMNFFKTEITLANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEKGKSKKLKSVKELLGITIME

RSSFEKNPIDFLEAKGYKEVKKDLIIKLPKYSLFELENGRKRMLASARELQKGNELALPSKYVNFLYLA

SHYEKLKGSPEDNEQKQLFVEQHKHYLDEIIEQISEFSKRVILADANLDKVLSAYNKHRDKPIREQAENI

IHLFTLTNLGAPAAFKYFDTTIDRKQYRSTKEVLDATLIHQSITGLYETRIDLSQLGGD

SaKKH-nCas9 (D10A/E782K/N968K/R1015H) *S. aureus* Cas9 Nickase (SEQ ID NO: 7)

MKRNYILGLAIGITSVGYGIIDYETRDVIDAGVRLFKEANVENNEGRRSKRGARRLKRRRRHRIQRVKK

LLFDYNLLTDHSELSGINPYEARVKGLSQKLSEEEFSAALLHLAKRRGVHNVNEVEEDTGNELSTKEQI

SRNSKALEEKYVAELQLERLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLYNALNDLNNLVITRDENE

KLEYYEKFQIIENVFKQKKKPTLKQIAKEILVNEEDIKGYRVTSTGKPEFTNLKVYHDIKDITARKEIIEN

AELLDQIAKILTIYQSSEDIQEELTNLNSELTQLEIEQISNLKGYTGTHNLSLKAINLILDELWHTNDNQIA

IFNRLKLVPKKVDLSQQKEIPTTLVDDFILSPVVKRSFIQSIKVINAIIKKYGLPNDIIIELAREKNSKDAQK

MINEMQKRNRQTNERIEEIIRTTGKENAKYLIEKIKLHDMQEGKCLYSLEAIPLEDLLNNPFNYLVDHIIP

RSVSFDNSFNNKVLVKQEENSKKGNRTPFQYLSSSDSKISYETFKKHILNLAKGKGRISKTKKEYLLEER

DINRFSVQKDFINRNLVDTRYATRGLMNLLRSYFRVNNLDVKVKSINGGFTSFLRRKWKFKKERNKGY

KHHAEDALIIANADFIFKEWKKLDKAKKVMENQMFEEKQAESMPEIETEQEYKEIFITPHQIKHIKDFK

DYKYSHRVDKKPNRKLINDTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYYGNKLNAHLDITDDYPNSR

NKVVKLSLKPYRFDVYLDNGVYKFVTVKNLDVIKKENYYLVNSKCYLEAKKLKKISNQAEFIASFYKN

DLIKINGELYRVIGVNNDLLNRIEVNMIDITYREYLENMNDKRPPHIIKTIASKTQSIKKYSTDILGNLYE

VKSKKHPQIIKKG

*Streptococcus thermophilus* CRISPR1 Cas9 (St1Cas9) Nickase (D9A)

(SEQ ID NO: 8)

MSDLVLGLAIGIGSVGVGILNKVTGEIIHKNSRIFPAAQAENNLVRRTNRQGRRLTRRKKHRRVRLNRL

FEESGLITDFTKISINLNPYQLRVKGLTDELSNEELFIALKNMVKHRGISYLDDASDDGNSSIGDYAQIVK

ENSKQLETKTPGQIQLERYQTYGQLRGDFTVEKDGKKHRLINVFPTSAYRSEALRILQTQQEFNPQITDE

FINRYLEILTGKRKYYHGPGNEKSRTDYGRYRTSGETLDNIFGILIGKCTFYPDEFRAAKASYTAQEFNL

LNDLNNLTVPTETKKLSKEQKNQIINYVKNEKAMGPAKLFKYIAKLLSCDVADIKGYRIDKSGKAEIHT

FEAYRKMKTLETLDIEQMDRETLDKLAYVLTLNTEREGIQEALEHEFADGSFSQKQVDELVQFRKANS

SIFGKGWHNFSVKLMMELIPELYETSEEQMTILTRLGKQKTTSSSNKTKYIDEKLLTEEIYNPVVAKSVR

QAIKIVNAAIKEYGDFDNIVIEMARETNEDDEKKAIQKIQKANKDEKDAAMLKAANQYNGKAELPHSV

FHGHKQLATKIRLWHQQGERCLYTGKTISIHDLINNSNQFEVDHILPLSITFDDSLANKVLVYATANQE

KGQRTPYQALDSMDDAWSFRELKAFVRESKTLSNKKKEYLLTEEDISKFDVRKKFIERNLVDTRYASR

VVLNALQEHFRAHKIDTKVSVVRGQFTSQLRRHWGIEKTRDTYHHHAVDALIIAASSQLNLWKKQKN

TLVSYSEDQLLDIETGELISDDEYKESVFKAPYQHFVDTLKSKEFEDSILFSYQVDSKFNRKISDATIYAT

RQAKVGKDKADETYVLGKIKDIYTQDGYDAFMKIYKKDKSKFLMYRHDPQTPEKVIEPILENYPNKQI

NEKGKEVPCNPFLKYKEEHGYIRKYSKKGNGPEIKSLKYYDSKLGNHIDITPKDSNNKVVLQSVSPWR

ADVYFNKTTGKYEILGLKYADLQFEKGTGTYKISQLKYNDIKKKEGVDSDSEFKFTLYKNDLLLVKDT

ETKEQQLFRFLSRTMPKQKHYVELKPYDKQKFEGGEALIKVLGNVANSGQCKKGLGKSNISIYKVRTD

VLGNQHIIKNEGDKPKLDF

-continued

*Streptococcus thermophilus* CRISPR3Cas9 (St3Cas9) Nickase (D10A)

(SEQ ID NO: 9)

MTKPYSIGLAIGTNSVGWAVITDNYKVPSKKMKVLGNTSKKYIKKNLLGVLLFDSGITAEGRRLKRTA

RRRYTRRRNRILYLQEIFSTEMATLDDAFFQRLDDSFLVPDDKRDSKYPIFGNLVEEKVYHDEFPTIYHL

RKYLADSTKKADLRLVYLALAHMIKYRGHFLIEGEFNSKNNDIQKNFQDFLDTYNAIFESDLSLENSKQ

LEEIVKDKISKLEKKDRILKLFPGEKNSGIFSEFLKLIVGNQADFRKCFNLDEKASLHFSKESYDEDLETL

LGYIGDDYSDVFLKAKKLYDAILLSGFLTVTDNETEAPLSSAMIKRYNEHKEDLALLKEYIRNISLKTYN

EVFKDDTKNGYAGYIDGKTNQEDFYVYLKNLLAEFEGADYFLEKIDREDFLRKQRTFDNGSIPYQIHLQ

EMRAILDKQAKFYPFLAKNKERIEKILTFRIPYYVGPLARGNSDFAWSIRKRNEKITPWNFEDVIDKESS

AEAFINRMTSFDLYLPEEKVLPKHSLLYETFNVYNELTKVRFIAESMRDYQFLDSKQKKDIVRLYFKDK

RKVTDKDIIEYLHAIYGYDGIELKGIEKQFNSSLSTYHDLLNIINDKEFLDDSSNEAIIEEIIHTLTIFEDRE

MIKQRLSKFENIFDKSVLKKLSRRHYTGWGKLSAKLINGIRDEKSGNTILDYLIDDGISNRNFMQLIHDD

ALSFKKKIQKAQIIGDEDKGNIKEVVKSLPGSPAIKKGILQSIKIVDELVKVMGGRKPESIVVEMARENQ

YTNQGKSNSQQRLKRLEKSLKELGSKILKENIPAKLSKIDNNALQNDRLYLYYLQNGKDMYTGDDLDI

DRLSNYDIDHIIPQAFLKDNSIDNKVLVSSASNRGKSDDFPSLEVVKKRKTFWYQLLKSKLISQRKFDNL

TKAERGGLLPEDKAGFIQRQLVETRQITKHVARLLDEKFNNKKDENNRAVRTVKIITLKSTLVSQFRKD

FELYKVREINDFHHAHDAYLNAVIASALLKKYPKLEPEFVYGDYPKYNSFRERKSATEKVYFYSNIMNI

FKKSISLADGRVIERPLIEVNEETGESVWNKESDLATVRRVLSYPQVNVVKKVEEQNHGLDRGKPKGL

FNANLSSKPKPNSNENLVGAKEYLDPKKYGGYAGISNSFAVLVKGTIEKGAKKKITNVLEFQGISILDRI

NYRKDKLNFLLEKGYKDIELIIELPKYSLFELSDGSRRMLASILSTNNKRGEIHKGNQIFLSQKFVKLLYH

AKRISNTINENHRKYVENHKKEFEELFYYILEFNENYVGAKKNGKLLNSAFQSWQNHSIDELCSSFIGPT

GSERKGLFELTSRGSAADFEFLGVKIPRYRDYTPSSLLKDATLIHQSVTGLYETRIDLAKLGEG

*S. aureus* Cas9 wild type (SEQ ID NO: 10)

MKRNYILGLDIGITSVGYGIIDYETRDVIDAGVRLFKEANVENNEGRRSKRGARRLKRRRRHRIQRVKK

LLFDYNLLTDHSELSGINPYEARVKGLSQKLSEEEFSAALLHLAKRRGVHNVNEVEEDTGNELSTKEQI

SRNSKALEEKYVAELQLERLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLYNALNDLNNLVITRDENE

KLEYYEKFQIIENVFKQKKKPTLKQIAKEILVNEEDIKGYRVTSTGKPEFTNLKVYHDIKDITARKEIIEN

AELLDQIAKILTIYQSSEDIQEELTNLNSELTQLEIEQISNLKGYTGTHNLSLKAINLILDELWHTNDNQIA

IFNRLKLVPKKVDLSQQKEIPTTLVDDFILSPVVKRSFIQSIKVINAIIKKYGLPNDIIIELAREKNSKDAQK

MINEMQKRNRQTNERIEEIIRTTGKENAKYLIEKIKLHDMQEGKCLYSLEAIPLEDLLNNPFNYEVDHIIP

RSVSFDNSFNNKVLVKQEENSKKGNRTPFQYLSSSDSKISYETFKKHILNLAKGKGRISKTKKEYLLEER

DINRFSVQKDFINRNLVDTRYATRGLMNLLRSYFRVNNLDVKVKSINGGFTSFLRRKWKFKKERNKGY

KHHAEDALIIANADFIFKEWKKLDKAKKVMENQMFEEKQAESMPEIETEQEYKEIFITPHQIKHIKDFK

DYKYSHRVDKKPNRELINDTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAKKLKKISNQAEFIASFYNN

DLIKINGELYRVIGVNNDLLNRIEVNMIDITYREYLENMNDKRPPRIIKTIASKTQSIKKYSTDILGNLYE

VKSKKHPQIIKKG

*S. aureus* Cas9 Nickase (D10A)

(SEQ ID NO: 11)

MKRNYILGLAIGITSVGYGIIDYETRDVIDAGVRLFKEANVENNEGRRSKRGARRLKRRRRHRIQRVKK

LLFDYNLLTDHSELSGINPYEARVKGLSQKLSEEEFSAALLHLAKRRGVHNVNEVEEDTGNELSTKEQI

-continued

SRNSKALEEKYVAELQLERLKKDGEVRGSINRFKTSDYVKEAKQLLKVQKAYHQLDQSFIDTYIDLLE

TRRTYYEGPGEGSPFGWKDIKEWYEMLMGHCTYFPEELRSVKYAYNADLYNALNDLNNLVITRDENE

KLEYYEKFQIIENVFKQKKKPTLKQIAKEILVNEEDIKGYRVTSTGKPEFTNLKVYHDIKDITARKEIIEN

AELLDQIAKILTIYQSSEDIQEELTNLNSELTQEEIEQISNLKGYTGTHNLSLKAINLILDELWHTNDNQIA

IFNRLKLVPKKVDLSQQKEIPTTLVDDFILSPVVKRSFIQSIKVINAIIKKYGLPNDIIIELAREKNSKDAQK

MINEMQKRNRQTNERIEEIIRTTGKENAKYLIEKIKLHDMQEGKCLYSLEAIPLEDLLNNPFNYEVDHIIP

RSVSFDNSFNNKVLVKQEENSKKGNRTPFQYLSSSDSKISYETFKKHILNLAKGKGRISKTKKEYLLEER

DINRFSVQKDFINRNLVDTRYATRGLMNLLRSYFRVNNLDVKVKSINGGFTSFLRRKWKF1KKERNKG

YKHHAEDALIIANADFIFKEWKKLDKAKKVMENQMFEEKQAESMPEIETEQEYKEIFITPHQIKHIKDF

KDYKYSHRVDKKPNRELINDTLYSTRKDDKGNTLIVNNLNGLYDKDNDKLKKLINKSPEKLLMYHHD

PQTYQKLKLIMEQYGDEKNPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAKKLKKISNQAEFIASFYNN

DLIKINGELYRVIGVNNDLLNRIEVNMIDITYREYLENMNDKRPPRIIKTIASKTQSIKKYSTDILGNLYE

VKSKKHPQIIKKG

*Streptococcus thermophilus* wild type CRISPR3 Cas9 (St3Cas9)

(SEQ ID NO: 12)

MTKPYSIGLDIGTNSVGWAVITDNYKVPSKKMKVLGNTSKKYIKKNLLGVLLFDSGITAEGRRLKRTA

RRRYTRRRNRILYLQEIFSTEMATLDDAFFQRLDDSFLVPDDKRDSKYPIFGNLVEEKVYHDEFPTIYHL

RKYLADSTKKADLRLVYLALAHMIKYRGHFLIEGEFNSKNNDIQKNFQDFLDTYNAIFESDLSLENSKQ

LEEIVKDKISKLEKKDRILKLFPGEKNSGIFSEFLKLIVGNQADFRKCFNLDEKASLHFSKESYDEDLETL

LGYIGDDYSDVFLKAKKLYDAILLSGFLTVTDNETEAPLSSAMIKRYNEHKEDLALLKEYIRNISLKTYN

EVFKDDTKNGYAGYIDGKTNQEDFYVYLKNLLAEFEGADYFLEKIDREDFLRKQRTFDNGSIPYQIHLQ

EMRAILDKQAKFYPFLAKNKERIEKILTFRIPYYVGPLARGNSDFAWSIRKRNEKITPWNFEDVIDKESS

AEAFINRMTSFDLYLPEEKVLPKHSLLYETFNVYNELTKVRFIAESMRDYQFLDSKQKKDIVRLYFKDK

RKVTDKDIIEYLHAIYGYDGIELKGIEKQFNSSLSTYHDLLNIINDKEFLDDSSNEAIIEEIIHTLTIFEDRE

MIKQRLSKFENIFDKSVLKKLSRRHYTGWGKLSAKLINGIRDEKSGNTILDYLIDDGISNRNFMQLIHDD

ALSFKKKIQKAQIIGDEDKGNIKEVVKSLPGSPAIKKGILQSIKIVDELVKVMGGRKPESIVVEMARENQ

YTNQGKSNSQQRLKRLEKSLKELGSKILKENIPAKLSKIDNNALQNDRLYLYYLQNGKDMYTGDDLDI

DRLSNYDIDHIIPQAFLKDNSIDNKVLVSSASNRGKSDDFPSLEVVKKRKTFWYQLLKSKLISQRKFDNL

TKAERGGLLPEDKAGFIQRQLVETRQITKHVARLLDEKFNNKKDENNRAVRTVKIITLKSTLVSQFRKD

FELYKVREINDFHHAHDAYLNAVIASALLKKYPKLEPEFVYGDYPKYNSFRERKSATEKVYFYSNIMNI

FKKSISLADGRVIERPLIEVNEETGESVWNKESDLATVRRVLSYPQVNVVKKVEEQNHGLDRGKPKGL

FNANLSSKPKPNSNENLVGAKEYLDPKKYGGYAGISNSFAVLVKGTIEKGAI(KKITNVLEFQGISILDRI

NYRKDKLNFLLEKGYKDIELIIELPKYSLFELSDGSRRMLASILSTNNKRGEIHKGNQIFLSQKFVKLLYH

AKRISNTINENHRKYVENHKKEFEELFYYILEFNENYVGAKKNGKLLNSAFQSWQNHSIDELCSSFIGPT

GSERKGLFELTSRGSAADFEFLGVKIPRYRDYTPSSLLKDATLIHQSVTGLYETRIDLAKLGEG

*Streptococcus thermophilus* CRISPR1 Cas9 wild type (St1Cas9)

(SEQ ID NO: 13)

MSDLVLGLDIGIGSVGVGILNKVTGEIIHKNSRIFPAAQAENNLVRRTNRQGRRLTRRKKHRRVRLNRL

FEESGLITDFTKISINLNPYQLRVKGLTDELSNEELFIALKNMVKHRGISYLDDASDDGNSSIGDYAQIVK

ENSKQLETKTPGQIQLERYQTYGQLRGDFTVEKDGKKHRLINVFPTSAYRSEALRILQTQQEFNPQITDE

FINRYLEILTGKRKYYHGPGNEKSRTDYGRYRTSGETLDNIFGILIGKCTFYPDEFRAAKASYTAQEFNL

-continued

LNDLNNLTVPTETKKLSKEQKNQIINYVKNEKAMGPAKLFKYIAKLLSCDVADIKGYRIDKSGKAEIHT

FEAYRKMKTLETLDIEQMDRETLDKLAYVLTLNTEREGIQEALEHEFADGSFSQKQVDELVQFRKANS

SIFGKGWHNFSVKLMMELIPELYETSEEQMTILTRLGKQKTTSSSNKTKYIDEKLLTEEIYNPVVAKSVR

QAIKIVNAAIKEYGDFDNIVIEMARETNEDDEKKAIQKIQKANKDEKDAAMLKAANQYNGKAELPHSV

FHGHKQLATKIRLWHQQGERCLYTGKTISIHDLINNSNQFEVDHILPLSITFDDSLANKVLVYATANQE

KGQRTPYQALDSMDDAWSFRELKAFVRESKTLSNKKKEYLLTEEDISKFDVRKKFIERNLVDTRYASR

VVLNALQEHFRAHKIDTKVSVVRGQFTSQLRRHWGIEKTRDTYHHHAVDALIIAASSQLNLWKKQKN

TLVSYSEDQLLDIETGELISDDEYKESVFKAPYQHFVDTLKSKEFEDSILFSYQVDSKFNRKISDATIYAT

RQAKVGKDKADETYVLGKIKDIYTQDGYDAFMKIYKKDKSKFLMYRHDPQTPEKVIEPILENYPNKQI

NEKGKEVPCNPFLKYKEEHGYIRKYSKKGNGPEIKSLKYYDSKLGNHIDITPKDSNNKVVLQSVSPWR

ADVYFNKTTGKYEILGLKYADLQFEKGTGTYKISQLKYNDIKKKEGVDSDSEFKFTLYKNDLLLVKDT

ETKEQQLFRFLSRTMPKQKHYVELKPYDKQKFEGGEALIKVLGNVANSGQCKKGLGKSNISIYKVRTD

VLGNQHIIKNEGDKPKLDF

CasX from *Sulfolobus islandicus* (strain REY15A)

(SEQ ID NO: 14)

MEVPLYNIFGDNYIIQVATEAENSTIYNNKVEIDDEELRNVLNLAYKIAKNNEDAAAERRGKAKKKKG

LEGETTTSNIILPLSGNDKNPWTETLKCYNFPTTVALSEVFKNFSQVKECEEVSAPSFVKPEFYKFGRSP

GMVERTRRVKLEVEPHYLIMAAAGWVLTRLGKAKVSEGDYVGVNVFTPTRGILYSLIQNVNGIVPGIK

PETAFGLWIARKVVSSVTNPNVSVVSIYTISDAVGQNPTTINGGFSIDLTKLLEKRDLLSERLEAIARNAL

SISSNMRERYIVLANYIYEYLTGSKRLEDLLYFANRDLIMNLNSDDGKVRDLKLISAYVNGELIRGEG

CasY from *Sulfolobus islandicus* (strain REY15A)

(SEQ ID NO: 15)

MEVPLYNIFGDNYIIQVATEAENSTIYNNKVEIDDEELRNVLNLAYKIAKNNEDAAAERRGKAKKKKG

LEGETTTSNIILPLSGNDKNPWTETLKCYNFPTTVALSEVFKNFSQVKECEEVSAPSFVKPEFYLFGRSPG

MVERTRRVKLEVEPHYLIIAAAGWVLTRLGKAKVSEGDYVGVNVFTPTRGILYSLIQNVNGIVPGIKPE

TAFGLWIARKVVSSVTNPNVSVVRIYTISDAVGQNPTTINGGFSIDLTKLLEKRYLLSERLEAIARNALSI

SSNMRERYIVLANYIYEYLTGSKRLEDLLYFANRDLIMNLNSDDGKVRDLKLISAYVNGELIRGEG

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "editing window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

For example, a napDNAbp domain with altered PAM specificity, such as a domain with at least 80%, at least 85%, at least 90%, at least 95%, or at least 99% sequence identity with wild type *Francisella novicida* Cpf1 (SEQ ID NO: 16) (D917, E1006, and D1255), which has the following amino acid sequence:

Wild type *Francisella novicida* Cpf1
(D917, E1006, and D1255 are bolded and underlined)

(SEQ ID NO: 16)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

-continued

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D917A
(A917, E1006, and D1255 are bolded and underlined)

(SEQ ID NO: 17)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

-continued

*Francisella novicida* Cpf1 E1006A
(D917, A1006, and D1255 are bolded and underlined)

(SEQ ID NO: 18)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D1255A
(D917, E1006, and A1255 are bolded and underlined)

(SEQ ID NO: 19)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

-continued

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 D917A/E1006A
(A917, A1006, and D1255 are bolded and underlined)

(SEQ ID NO: 20)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D917A/D1255A
(A917, E1006, and A1255 are bolded and underlined)

(SEQ ID NO: 21)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLNYLVFKDNEFDK

-continued

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 E1006A/D1255A
(D917, A1006, and A1255 are bolded and underlined)

(SEQ ID NO: 22)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIDRGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 D917A/E1006A/D1255A
(A917, A1006, and A1255 are bolded and underlined)

(SEQ ID NO: 23)

MSIYQEFVNKYSLSKTLRFELIPQGKTLENIKARGLILDDEKRAKDYKKAKQIIDKYHQFFIEEILSSVCIS

EDLLQNYSDVYFKLKKSDDDNLQKDFKSAKDTIKKQISEYIKDSEKFKNLFNQNLIDAKKGQESDLILW

LKQSKDNGIELFKANSDITDIDEALEIIKSFKGWTTYFKGFHENRKNVYSSNDIPTSIIYRIVDDNLPKFLE

NKAKYESLKDKAPEAINYEQIKKDLAELLTFDIDYKTSEVNQRVFSLDEVFEIANFNNYLNQSGITKFNT

IIGGKFVNGENTKRKGINEYINLYSQQINDKTLKKYKMSVLFKQILSDTESKSFVIDKLEDDSDVVTTMQ

SFYEQIAAFKTVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFAAIPMIFDEIAQ

NKDNLAQISIKYQNQGKKDLLQASAEDDVKAIKDLLDQTNNLLHKLKIFHISQSEDKANILDKDEHFYL

VFEECYFELANIVPLYNKIRNYITQKPYSDEKFKLNFENSTLANGWDKNKEPDNTAILFIKDDKYYLGV

MNKKNNKIFDDKAIKENKGEGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSIDEFYREVENQGYKLTFENISES

YIDSVVNQGKLYLFQIYNKDFSAYSKGRPNLHTLYWKALFDERNLQDVVYKLNGEAELFYRKQSIPKK

ITHPAKEAIANKNKDNPKKESVFEYDLIKDKRFTEDKFFFHCPITINFKSSGANKFNDEINLLLKEKAND

VHILSIARGERHLAYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKLNYLVFKDNEFDK

-continued

TGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEY

GHGECIKAAICGESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

An additional napDNAbp domain with altered PAM specificity, such as a domain having at least 80%, at least 85%, at least 90%, at least 95%, or at least 99% sequence identity with wild type *Geobacillus thermodenbrificans* Cas9 (SEQ ID NO: 519):

(SEQ ID NO: 519)

MKYKIGLDIGITSIGWAVINLDIPRIEDLGVRIFDRAENPKTGESLALPRRLARSARRRLRRRK

HRLERIRRLFVREGILTKEELNKLFEKKHEIDVWQLRVEALDRKLNNDELARILLHLAKRRGF

RSNRKSERTNKENSTMLKHIEENQSILSSYRTVAEMVVKDPKFSLHKRNKEDNYTNTVARDD

LEREIKLIFAKQREYGNIVCTEAFEHEYISIWASQRPFASKDDIEKKVGFCTFEPKEKRAPKAT

YTFQSFTVWEHINKLRLVSPGGIRALTDDERRLIYKQAFHKNKITFHDVRTLLNLPDDTRFKG

LLYDRNTTLKENEKVRFLELGAYHKIRKAIDSVYGKGAAKSFRPIDFDTFGYALTMFKDDTDI

RSYLRNEYEQNGKRMENLADKVYDEELIEELLNLSFSKFGHLSLKALRNILPYMEQGEVYST

ACERAGYTFTGPKKKQKTVLLPNIPPIANPVVMRALTQARKVVNAIIKKYGSPVSIHIELAREL

SQSFDERRKMQKEQEGNRKKNETAIRQLVEYGLTLNPTGLDIVKFKLWSEQNGKCAYSLQPI

EIERLLEPGYTEVDHVIPYSRSLDDSYTNKVLVLTKENREKGNRTPAEYLGLGSERWQQFETF

VLTNKQFSKKKRDRLLRLHYDENEENEFKNRNLNDTRYISRFLANFIREHLKFADSDDKQKV

YTVNGRITAHLRSRWNFNKNREESNLHHAVDAAIVACTTPSDIARVTAFYQRREQNKELSKK

TDPQFPQPWPHFADELQARLSKNPKESIKALNLGNYDNEKLESLQPVFVSRMPKRSITGAAH

QETLRRYIGIDERSGKIQTVVKKKLSEIQLDKTGHFPMYGKESDPRTYEAIRQRLLEHNNDPK

KAFQEPLYKPKKNGELGPIIRTIKIIDTTNQVIPLNDGKTVAYNSNIVRVDVFEKDGKYYCVPI

YTIDMMKGILPNKAIEPNKPYSEWKEMTEDYTFRFSLYPNDLIRIEFPREKTIKTAVGEEIKIKD

LFAYYQTIDSSNGGLSLVSHDNNFSLRSIGSRTLKRFEKYQVDVLGNIYKVRGEKRVGVASSS

HSKAGETIRPL

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is an ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 34(7): 768-73 (2016), PubMed PMID: 27136078; Swarts et al., *Nature,* 507(7491): 258-61 (2014); and Swarts et al., *Nucleic Acids Res.* 43(10) (2015): 5120-9, each of which is incorporated herein by reference. The sequence of *Natronobacterium gregoryi* Argonaute is provided in SEQ ID NO: 24.

The disclosed fusion proteins may comprise a napDNAbp domain having at least 80%, at least 85%, at least 90%, at least 95%, or at least 99% sequence identity with wild type *Natronobacterium gregoryi* Argonaute (SEQ ID NO: 24), which has the following amino acid sequence:

(SEQ ID NO: 24)

MTVIDLDSTTTADELTSGHTYDISVTLTGVYDNTD

EQHPRMSLAFEQDNGERRYITLWKNTTPKDVFTYD

YATGSTYIFTNIDYEVKDGYENLTATYQTTVENAT

AQEVGTTDEDETFAGGEPLDHHLDDALNETPDDAE

TESDSGHVMTSFASRDQLPEWTLHTYTLTATDGAK

TDTEYARRTLAYTVRQELYTDHDAAPVATDGLMLL

TPEPLGETPLDLDCGVRVEADETRTLDYTTAKDRL

LARELVEEGLKRSLWDDYLVRGIDEVLSKEPVLTC

DEFDLHERYDLSVEVGHSGRAYLHINFRHRFVPKL

TLADIDDDNIYPGLRVKTTYRPRRGHIVWGLRDEC

ATDSLNTLGNQSVVAYHRNNQTPINTDLLDAIEAA

DRRVVETRRQGHGDDAVSFPQELLAVEPNTHQIKQ

FASDGFHQQARSKTRLSASRCSEKAQAFAERLDPV

RLNGSTVEFSSEFFTGNNEQQLRLLYENGESVLTF

-continued

RDGARGAHPDETFSKGIVNPPESFEVAVVLPEQQA

DTCKAQWDTMADLLNQAGAPPTRSETVQYDAFSSP

ESISLNVAGAIDPSEVDAAFVVLPPDQEGFADLAS

PTETYDELKKALANMGIYSQMAYFDRFRDAKIFYT

RNVALGLLAAAGGVAFTTEHAMPGDADMFIGIDVS

RSYPEDGASGQINIAATATAVYKDGTILGHSSTRP

QLGEKLQSTDVRDIMKNAILGYQQVTGESPTHIVI

HRDGFMNEDLDPATEFLNEQGVEYDIVEIRKQPQT

RLLAVSDVQYDTPVKSIAAINQNEPRATVATFGAP

EYLATRDGGGLPRPIQIERVAGETDIETLTRQVYL

LSQSHIQVHNSTARLPITTAYADQASTHATKGYLV

QTGAFESNVGFL

Cas9 variant with decreased electrostatic interactions between the Cas9 and DNA backbone (SEQ ID NO: 25)

DKKYSIGLAIGTNSVGWAVITDEYKVPSKKFKVLG

NTDRHSIKKNLIGALLFDSGETALATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQLEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTAFDKNLPNEKVLPKHSLLYEYFTVYNELTK

VKYVTEGMRKPAFLSGEQKKAIVDLLFKTNRKVTV

KQLKEDYFKKIECFDSVEISGVEDRFNASLGTYHD

LLKIIKDKDFLDNEENEDILEDIVLTLTLFEDREM

IEERLKTYAHLFDDKVMKQLKRRRYTGWGALSRKL

INGIRDKQSGKTILDFLKSDGFANRNFMALIHDDS

LTFKEDIQKAQVSGQGDSLHEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDHI

VPQSFLKDDSIDNKVLTRSDKNRGKSDNVPSEEVV

KKMKNYWRQLLNAKLITQRKFDNLTKAERGGLSEL

DKAGFIKRQLVETRAITKHVAQILDSRMNTKYDEN

-continued

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEIT

LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD

CasY (ncbi.nlm.nih.gov/protein/APG80656.1) >APG80656.1 CRISPR-associated protein CasY [uncultured *Parcubacteria* group bacterium]

(SEQ ID NO: 26)

MSKRHPRISGVKGYRLHAQRLEYTGKSGAMRTIKY

PLYSSPSGGRTVPREIVSAINDDYVGLYGLSNFDD

LYNAEKRNEEKVYSVLDFWYDCVQYGAVFSYTAPG

LLKNVAEVRGGSYELTKTLKGSHLYDELQIDKVIK

FLNKKEISRANGSLDKLKKDIIDCFKAEYRERHKD

QCNKLADDIKNAKKDAGASLGERQKKLFRDFFGIS

EQSENDKPSFTNPLNLTCCLLPFDTVNNNRNRGEV

LFNKLKEYAQKLDKNEGSLEMWEYIGIGNSGTAFS

NFLGEGFLGRLRENKITELKKAMMDITDAWRGQEQ

EEELEKRLRILAALTIKLREPKFDNHWGGYRSDIN

GKLSSWLQNYINQTVKIKEDLKGHKKDLKKAKEMI

NRFGESDTKEEAVVSSLLESIEKIVPDDSADDEKP

DIPAIAIYRRFLSDGRLTLNRFVQREDVQEALIKE

RLEAEKKKKPKKRKKKSDAEDEKETIDFKELFPHL

AKPLKLVPNFYGDSKRELYKKYKNAAIYTDALWKA

VEKIYKSAFSSSLKNSFFDTDFDKDFFIKRLQKIF

SVYRRFNTDKWKPIVKNSFAPYCDIVSLAENEVLY

KPKQSRSRKSAAIDKNRVRLPSTENIAKAGIALAR

ELSVAGFDWKDLLKKEEHEEYIDLIELHKTALALL

LAVTETQLDISALDFVENGTVKDFMKTRDGNLVLE

GRFLEMFSQSIVFSELRGLAGLMSRKEFITRSAIQ

TMNGKQAELLYIPHEFQSAKITTPKEMSRAFLDLA

PAEFATSLEPESLSEKSLLKLKQMRYYPHYFGYEL

TRTGQGIDGGVAENALRLEKSPVKKREIKCKQYKT

LGRGQNKIVLYVRSSYYQTQFLEWFLHRPKNVQTD

-continued

VAVSGSFLIDEKKVKTRWNYDALTVALEPVSGSER

VFVSQPFTIFPEKSAEEEGQRYLGIDIGEYGIAYT

ALEITGDSAKILDQNFISDPQLKTLREEVKGLKLD

QRRGTFAMPSTKIARIRESLVHSLRNRIHHLALKH

KAKIVYELEVSRFEEGKQKIKKVYATLKKADVYSE

IDADKNLQTTVWGKLAVASEISASYTSQFCGACKK

LWRAEMQVDETITTQELIGTVRVIKGGTLIDAIKD

FMRPPIFDENDTPFPKYRDFCDKHHISKKMRGNSC

LFICPFCRANADADIQASQTIALLRYVKEEKKVED

YFERFRKLKNIKVLGQMKKI

High-fidelity Cas9 domain (SEQ ID NO: 394)

DKKYSIGLAIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTAFDKNLPNEKVLPKHSLLYEYFTVYNELTK

VKYVTEGMRKPAFLSGEQKKAIVDLLFKTNRKVTV

KQLKEDYFKKIECFDSVEISGVEDRFNASLGTYHD

LLKIIKDKDFLDNEENEDILEDIVLTLTLFEDREM

IEERLKTYAHLFDDKVMKQLKRRRYTGWGALSRKL

INGIRDKQSGKTILDFLKSDGFANRNFMALIHDDS

LTFKEDIQKAQVSGQGDSLHEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDHI

VPQSFLKDDSIDNKVLTRSDKNRGKSDNVPSEEVV

KKMKNYWRQLLNAKLITQRKFDNLTKAERGGLSEL

DKAGFIKRQLVETRAITKHVAQILDSRMNTKYDEN

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEIT

-continued

LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD

C2c1 (uniprot.org/uniprot/T0D7A2#)
sp|T0D7A2|C2C1_ALIAG CRISPR-associated endonuclease C2c1 OS = *Alicyclobacillus acidoterrestris* (strain ATCC 49025/DSM 3922/CIP 106132/NCIMB 13137/GD3B) GN = c2c1 PE = 1 SV = 1

(SEQ ID NO: 395)

MAVKSIKVKLRLDDMPEIRAGLWKLHKEVNAGVRY

YTEWLSLLRQENLYRRSPNGDGEQECDKTAEECKA

ELLERLRARQVENGHRGPAGSDDELLQLARQLYEL

LVPQAIGAKGDAQQIARKFLSPLADKDAVGGLGIA

KAGNKPRWVRMREAGEPGWEEEKEKAETRKSADRT

ADVLRALADFGLKPLMRVYTDSEMSSVEWKPLRKG

QAVRTWDRDMFQQAIERMMSWESWNQRVGQEYAKL

VEQKNRFEQKNFVGQEHLVHLVNQLQQDMKEASPG

LESKEQTAHYVTGRALRGSDKVFEKWGKLAPDAPF

DLYDAEIKNVQRRNTRRFGSHDLFAKLAEPEYQAL

WREDASFLTRYAVYNSILRKLNHAKMFATFTLPDA

TAHPIWTRFDKLGGNLHQYTFLFNEFGERRHAIRF

HKLLKVENGVAREVDDVTVPISMSEQLDNLLPRDP

NEPIALYFRDYGAEQHFTGEFGGAKIQCRRDQLAH

MHRRRGARDVYLNVSVRVQSQSEARGERRPPYAAV

FRLVGDNHRAFVHFDKLSDYLAEHPDDGKLGSEGL

LSGLRVMSVDLGLRTSASISVFRVARKDELKPNSK

GRVPFFFPIKGNDNLVAVHERSQLLKLPGETESKD

LRAIREERQRTLRQLRTQLAYLRLLVRCGSEDVGR

RERSWAKLIEQPVDAANHMTPDWREAFENELQKLK

SLHGICSDKEWMDAVYESVRRVWRHMGKQVRDWRK

DVRSGERPKIRGYAKDVVGGNSIEQIEYLERQYKF

LKSWSFFGKVSGQVIRAEKGSRFAITLREHIDHAK

EDRLKKLADRIIMEALGYVYALDERGKGKWVAKYP

PCQLILLEELSEYQFNNDRPPSENNQLMQWSHRGV

FQELINQAQVHDLLVGTMYAAFSSRFDARTGAPGI

RCRRVPARCTQEHNPEPFPWWLNKFVVEHTLDACP

-continued

LRADDLIPTGEGEIFVSPFSAEEGDFHQIHADLNA

AQNLQQRLWSDFDISQIRLRCDWGEVDGELVLIPR

LTGKRTADSYSNKVFYTNTGVTYYERERGKKRRKV

FAQEKLSEEEAELLVEADEAREKSVVLMRDPSGII

NRGNWTRQKEFWSMVNQRIEGYLVKQIRSRVPLQD

SACENTGDI

C2c2 (uniprot.org/uniprot/P0DOC6) >sp|P0DOC6|C2C2 LEPSD CRISPR-associated endoribonuclease C2c2 OS = *Leptotrichia shahii* (strain DSM 19757/CCUG 47503/CIP 107916/JCM 16776/LB37) GN = c2c2 PE = 1 SV = 1

(SEQ ID NO: 396)

MGNLFGHKRWYEVRDKKDFKIKRKVKVKRNYDGNK

YILNINENNNKEKIDNNKFIRKYINYKKNDNILKE

FTRKFHAGNILFKLKGKEGIIRIENNDDFLETEEV

VLYIEAYGKSEKLKALGITKKKIIDEAIRQGITKD

DKKIEIKRQENEEEIEIDIRDEYTNKTLNDCSIIL

RIIENDELETKKSIYEIFKNINMSLYKIIEKIIEN

ETEKVFENRYYEEHLREKLLKDDKIDVILTNFMEI

REKIKSNLEILGFVKFYLNVGGDKKKSKNKKMLVE

KILNINVDLTVEDIADFVIKELEFWNITKRIEKVK

KVNNEFLEKRRNRTYIKSYVLLDKHEKFKIERENK

KDKIVKFFVENIKNNSIKEKIEKILAEFKIDELIK

KLEKELKKGNCDTEIFGIFKKHYKVNFDSKKFSKK

SDEEKELYKIIYRYLKGRIEKILVNEQKVRLKKME

KIEIEKILNESILSEKILKRVKQYTLEHIMYLGKL

RHNDIDMTTVNTDDFSRLHAKEELDLELITFFAST

NMELNKIFSRENINNDENIDFFGGDREKNYVLDKK

ILNSKIKIIRDLDFIDNKNNITNNFIRKFTKIGTN

ERNRILHAISKERDLQGTQDDYNKVINIIQNLKIS

DEEVSKALNLDVVFKDKKNIITKINDIKISEENNN

DIKYLPSFSKVLPEILNLYRNNPKNEPFDTIETEK

IVLNALIYVNKELYKKLILEDDLEENESKNIFLQE

LKKTLGNIDEIDENIIENYYKNAQISASKGNNKAI

KKYQKKVIECYIGYLRKNYEELFDFSDFKMNIQEI

KKQIKDINDNKTYERITVKTSDKTIVINDDFEYII

SIFALLNSNAVINKIRNRFFATSVWLNTSEYQNII

DILDEIMQLNTLRNECITENWNLNLEEFIQKMKEI

EKDFDDFKIQTKKEIFNNYYEDIKNNILTEFKDDI

NGCDVLEKKLEKIVIFDDETKFEIDKKSNILQDEQ

RKLSNINKKDLKKKVDQYIKDKDQEIKSKILCRII

FNSDFLKKYKKEIDNLIEDMESENENKFQEIYYPK

ERKNELYIYKKNLFLNIGNPNFDKIYGLISNDIKM

-continued

ADAKFLFNIDGKNIRKNKISEIDAILKNLNDKLNG

YSKEYKEKYIKKLKENDDFFAKNIQNKNYKSFEKD

YNRVSEYKKIRDLVEFNYLNKIESYLIDINWKLAI

QMARFERDMHYIVNGLRELGIIKLSGYNTGISRAY

PKRNGSDGFYTTTAYYKFFDEESYKKFEKICYGFG

IDLSENSEINKPENESIRNYISHFYIVRNPFADYS

IAEQIDRVSNLLSYSTRYNNSTYASVFEVFKKDVN

LDYDELKKKFKLIGNNDILERLMKPKKVSVLELES

YNSDYIKNLIIELLTKIENTNDTL

C2c3, translated from >CEPX01008730.1 marine metagenome genome assembly TARA_037_MES_0.1-0.22_contig TARA_037_MES_0.1-0.22_scaffold22115_1, whole genome shotgun sequence.

(SEQ ID NO: 397)

MRSNYHGGRNARQWRKQISGLARRTKETVFTYKFP

LETDAAEIDFDKAVQTYGIAEGVGHGSLIGLVCAF

HLSGFRLFSKAGEAMAFRNRSRYPTDAFAEKLSAI

MGIQLPTLSPEGLDLIFQSPPRSRDGIAPVWSENE

VRNRLYTNWTGRGPANKPDEHLLEIAGEIAKQVFP

KFGGWDDLASDPDKALAAADKYFQSQGDFPSIASL

PAAIMLSPANSTVDFEGDYIAIDPAAETLLHQAVS

RCAARLGRERPDLDQNKGPFVSSLQDALVSSQNNG

LSWLFGVGFQHWKEKSPKELIDEYKVPADQHGAVT

QVKSFVDAIPLNPLFDTTHYGEFRASVAGKVRSWV

ANYWKRLLDLKSLLATTEFTLPESISDPKAVSLFS

GLLVDPQGLKKVADSLPARLVSAEEAIDRLMGVGI

PTAADIAQVERVADEIGAFIGQVQQFNNQVKQKLE

NLQDADDEEFLKGLKIELPSGDKEPPAINRISGGA

PDAAAEISELEEKLQRLLDARSEHFQTISEWAEEN

AVTLDPIAAMVELERLRLAERGATGDPEEYALRLL

LQRIGRLANRVSPVSAGSIRELLKPVFMEEREFNL

FFHNRLGSLYRSPYSTSRHQPFSIDVGKAKAIDWI

AGLDQISSDIEKALSGAGEALGDQLRDWINLAGFA

ISQRLRGLPDTVPNALAQVRCPDDVRIPPLLAMLL

EEDDIARDVCLKAFNLYVSAINGCLFGALREGFIV

RTRFQRIGTDQIHYVPKDKAWEYPDRLNTAKGPIN

AAVSSDWIEKDGAVIKPVETVRNLSSTGFAGAGVS

EYLVQAPHDWYTPLDLRDVAHLVTGLPVEKNITKL

KRLTNRTAFRMVGASSFKTHLDSVLLSDKIKLGDF

TIIIDQHYRQSVTYGGKVKISYEPERLQVEAAVPV

VDTRDRTVPEPDTLFDHIVAIDLGERSVGFAVFDI

KSCLRTGEVKPIHDNNGNPVVGTVAVPSIRRLMKA

-continued

VRSHRRRRQPNQKVNQTYSTALQNYRENVIGDVCN

RIDTLMERYNAFPVLEFQIKNFQAGAKQLEIVYGS

*S. canis* (ScCas9)

(SEQ ID NO: 520)

MEKKYSIGLDIGTNSVGWAVITDDYKVPSKKFKVL

GNTNRKSIKKNLMGALLFDSGETAEATRLKRTARR

RYTRRKNRIRYLQEIFANEMAKLDDSFFQRLEESF

LVEEDKKNERHPIFGNLADEVAYHRNYPTIYHLRK

KLADSPEKADLRLIYLALAHIIKFRGHFLIEGKLN

AENSDVAKLFYQLIQTYNQLFEESPLDEIEVDAKG

ILSARLSKSKRLEKLIAVFPNEKKNGLFGNIIALA

LGLTPNFKSNFDLTEDAKLQLSKDTYDDDLDELLG

QIGDQYADLFSAAKNLSDAILLSDILRSNSEVTKA

PLSASMVKRYDEHHQDLALLKTLVRQQFPEKYAEI

FKDDTKNGYAGYVGIGIKHRKRTTKLATQEEFYKF

IKPILEKMDGAEELLAKLNRDDLLRKQRTFDNGSI

PHQIHLKELHAILRRQEEFYPFLKENREKIEKILT

FRIPYYVGPLARGNSRFAWLTRKSEEAITPWNFEE

VVDKGASAQSFIERMTNFDEQLPNKKVLPKHSLLY

EYFTVYNELTKVKYVTERMRKPEFLSGEQKKAIVD

LLFKTNRKVTVKQLKEDYFKKIECFDSVEIIGVED

RFNASLGTYHDLLKIIKDKDFLDNEENEDILEDIV

LTLTLFEDREMIEERLKTYAHLFDDKVMKQLKRRH

YTGWGRLSRKMINGIRDKQSGKTILDFLKSDGFSN

RNFMQLIHDDSLTFKEEIEKAQVSGQGDSLHEQIA

DLAGSPAIKKGILQTVKIVDELVKVMGHKPENIVI

EMARENQTTTKGLQQSRERKKRIEEGIKELESQIL

KENPVENTQLQNEKLYLYYLQNGRDMYVDQELDIN

RLSDYDVDHIVPQSFIKDDSIDNKVLTRSVENRGK

SDNVPSEEVVKKMKNYWRQLLNAKLITQRKFDNLT

KAERGGLSEADKAGFIKRQLVETRQITKHVARILD

SRMNTKRDKNDKPIREVKVITLKSKLVSDFRKDFQ

LYKVRDINNYHHAHDAYLNAVVGTALIKKYPKLES

EFVYGDYKVYDVRKMIAKSEQEIGKATAKRFFYSN

IMNFFKTEVKLANGEIRKRPLIETNGETGEVVWNK

EKDFATVRKVLAMPQVNIVKKTEVQTGGFSKESIL

SKRESAKLIPRKKGWDTRKYGGFGSPTVAYSILVV

AKVEKGKAKKLKSVKVLVGITIMEKGSYEKDPIGF

LEAKGYKDIKKELIFKLPKYSLFELENGRRRMLAS

ATELQKANELVLPQHLVRLLYYTQNISATTGSNNL

GYIEQHREEFKEIFEKIIDFSEKYILKNKVNSNLK

SSFDEQFAVSDSILLSNSFVSLLKYTSFGASGGFT

FLDLDVKQGRLRYQTVTEVLDATLIYQSITGLYET

RTDLSQLGGD

In some embodiments, the base editors described herein can include any Cas9 equivalent. As used herein, the term "Cas9 equivalent" is a broad term that encompasses any napDNAbp protein that serves the same function as Cas9 in the present base editors despite that its amino acid primary sequence and/or its three-dimensional structure may be different and/or unrelated from an evolutionary standpoint. Thus, while Cas9 equivalents include any Cas9 ortholog, homolog, mutant, or variant described or embraced herein that are evolutionarily related, the Cas9 equivalents also embrace proteins that may have evolved through convergent evolution processes to have the same or similar function as Cas9, but which do not necessarily have any similarity with regard to amino acid sequence and/or three dimensional structure. The base editors described here embrace any Cas9 equivalent that would provide the same or similar function as Cas9 despite that the Cas9 equivalent may be based on a protein that arose through convergent evolution.

For example, CasX is a Cas9 equivalent that reportedly has the same function as Cas9 but which evolved through convergent evolution. Thus, the CasX protein described in Liu et al., "CasX enzymes comprises a distinct family of RNA-guided genome editors," *Nature,* 2019, Vol. 566: 218-223, is contemplated to be used with the base editors described herein. In addition, any variant or modification of CasX is conceivable and within the scope of the present disclosure.

Cas9 is a bacterial enzyme that evolved in a wide variety of species. However, the Cas9 equivalents contemplated herein may also be obtained from archaea, which constitute a domain and kingdom of single-celled prokaryotic microbes different from bacteria.

In some embodiments, Cas9 equivalents may refer to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure. Also see Liu et al., "CasX enzymes comprises a distinct family of RNA-guided genome editors," *Nature,* 2019, Vol. 566: 218-223. Any of these Cas9 equivalents are contemplated.

In some embodiments, the Cas9 equivalent comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein.

In various embodiments, the nucleic acid programmable DNA binding proteins include, without limitation, Cas9 (e.g., dCas9 and nCas9), CasX, CasY, Cpf1, C2c1, C2c2, C2C3, Argonaute, Cas12a, and Cas12b. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference. The state of the art may also now refer to Cpf1 enzymes as Cas12a.

In still other embodiments, the Cas protein may include any CRISPR associated protein, including but not limited to, Cas12a, Cas12b, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof, and preferably comprising a nickase mutation (e.g., a mutation corresponding to the D10A mutation of the wild type Cas9 polypeptide of SEQ ID NO: 1).

In various other embodiments, the napDNAbp can be any of the following proteins: a Cas9, a Cpf1, a CasX, a CasY, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, a circularly permuted Cas9, or an Argonaute (Ago) domain, or a variant thereof.

Exemplary Cas9 equivalent protein sequences can include the following:

| Description | Sequence |
|---|---|
| AsCas12a (previously known as Cpf1) *Acidaminococcus* sp. (strain BV3L6) UniProtKB U2UMQ6 | MTQFEGFTNLYQVSKTLRFELIPQG<br>KTLKHIQEQGFIEEDKARNDHYKEL<br>KPIIDRIYKTYADQCLQLVQLDWEN<br>LSAAIDSYRKEKTEETRNALIEEQA<br>TYRNAIHDYFIGRTDNLTDAINKRH<br>AEIYKGLFKAELFNGKVLKQLGTVT<br>TTEHENALLRSFDKFTTYFSGFYEN<br>RKNVFSAEDISTAIPHRIVQDNFPK<br>FKENCHIFTRLITAVPSLREHFENV<br>KKAIGIFVSTSIEEVFSFPFYNQLL<br>TQTQIDLYNQLLGGISREAGTEKIK<br>GLNEVLNLAIQKNDETAHIIASLPH<br>RFIPLFKQILSDRNTLSFILEEFKS<br>DEEVIQSFCKYKTLLRNENVLETAE<br>ALFNELNSIDLTHIFISHKKLETIS<br>SALCDHWDTLRNALYERRISELTGK |

-continued

| Description | Sequence |
|---|---|
| | ITKSAKEKVRQRSLKHEDINLQEII<br>SAAGKELSEAFKQKTSEILSHAHAA<br>LDQPLPTTLKKQEEKEILKSQLDSL<br>LGLYHLLDWFAVDESNEVDPEFSAR<br>LTGIKLEMEPSLSFYNKARNYATKK<br>PYSVEKFKLNFQMPTLASGWDVNKE<br>KNNGAILFVKNGLYYLGIMPKQKGR<br>YKALSFEPTEKTSEGFDKMYYDYFP<br>DAAKMIPKCSTQLKAVTAHFQTHTT<br>PILLSNNFIEPLEITKEIYDLNNPE<br>KEPKKFQTAYAKKTGDQKGYREALC<br>KWIDFTRDFLSKYTKTTSIDLSSLR<br>PSSQYKDLGEYYAELNPLLYHISFQ<br>RIAEKEIMDAVETGKLYLFQIYNKD<br>FAKGHHGKPNLHTLYWTGLFSPENL<br>AKTSIKLNGQAELFYRPKSRMKRMA<br>HRLGEKMLNKKLKDQKTPIPDTLYQ<br>ELYDYVNHRLSHDLSDEARALLPNV<br>ITKEVSHEIIKDRRFTSDKFFFHVP<br>ITLNYQAANSPSKFNQRVNAYLKEH<br>PETPIIGIDRGERNLIYITVIDSTG<br>KILEQRSLNTIQQFDYQKKLDNREK<br>ERVAARQAWSVVGTIKDLKQGYLSQ<br>VIHEIVDLMIHYQAVVVLENLNFGF<br>KSKRTGIAEKAVYQQFEKMLIDKLN<br>CLVLKDYPAEKVGGVLNPYQLTDQF<br>TSFAKMGTQSGFLFYVPAPYTSKID<br>PLTGFVDPFVWKTIKNHESRKHFLE<br>GFDFLHYDVKTGDFILHFKMNRNLS<br>FQRGLPGFMPAWDIVFEKNETQFDA<br>KGTPFIAGKRIVPVIENHRFTGRYR<br>DLYPANELIALLEEKGIVFRDGSNI<br>LPKLLENDDSHAIDTMVALIRSVLQ<br>MRNSNAATGEDYINSPVRDLNGVCF<br>DSRFQNPEWPMDADANGAYHIALKG<br>QLLLNHLKESKDLKLQNGISNQDWL<br>AYIQELRN (SEQ ID NO: 120) |
| AsCas12a nickase (e.g., R1226A) | MTQFEGFTNLYQVSKTLRFELIPQG<br>KTLKHIQEQGFIEEDKARNDHYKEL<br>KPIIDRIYKTYADQCLQLVQLDWEN<br>LSAAIDSYRKEKTEETRNALIEEQA<br>TYRNAIHDYFIGRTDNLTDAINKRH<br>AEIYKGLFKAELFNGKVLKQLGTVT<br>TTEHENALLRSFDKFTTYFSGFYEN<br>RKNVFSAEDISTAIPHRIVQDNFPK<br>FKENCHIFTRLITAVPSLREHFENV<br>KKAIGIFVSTSIEEVFSFPFYNQLL<br>TQTQIDLYNQLLGGISREAGTEKIK<br>GLNEVLNLAIQKNDETAHIIASLPH<br>RFIPLFKQILSDRNTLSFILEEFKS<br>DEEVIQSFCKYKTLLRNENVLETAE<br>ALFNELNSIDLTHIFISHKKLETIS<br>SALCDHWDTLRNALYERRISELTGK<br>ITKSAKEKVRQRSLKHEDINLQEII<br>SAAGKELSEAFKQKTSEILSHAHAA<br>LDQPLPTTLKKQEEKEILKSQLDSL<br>LGLYHLLDWFAVDESNEVDPEFSAR<br>LTGIKLEMEPSLSFYNKARNYATKK<br>PYSVEKFKLNFQMPTLASGWDVNKE<br>KNNGAILFVKNGLYYLGIMPKQKGR<br>YKALSFEPTEKTSEGFDKMYYDYFP<br>DAAKMIPKCSTQLKAVTAHFQTHTT<br>PILLSNNFIEPLEITKEIYDLNNPE<br>KEPKKFQTAYAKKTGDQKGYREALC<br>KWIDFTRDFLSKYTKTTSIDLSSLR<br>PSSQYKDLGEYYAELNPLLYHISFQ<br>RIAEKEIMDAVETGKLYLFQIYNKD<br>FAKGHHGKPNLHTLYWTGLFSPENL<br>AKTSIKLNGQAELFYRPKSRMKRMA<br>HRLGEKMLNKKLKDQKTPIPDTLYQ<br>ELYDYVNHRLSHDLSDEARALLPNV<br>ITKEVSHEIIKDRRFTSDKFFFHVP<br>ITLNYQAANSPSKFNQRVNAYLKEH<br>PETPIIGIDRGERNLIYITVIDSTG<br>KILEQRSLNTIQQFDYQKKLDNREK<br>ERVAARQAWSVVGTIKDLKQGYLSQ |

-continued

| Description | Sequence |
|---|---|
| | VIHEIVDLMIHYQAVVVLENLNFGF KSKRTGIAEKAVYQQFEKMLIDKLN CLVLKDYPAEKVGGVLNPYQLTDQF TSFAKMGTQSGFLFYVPAPYTSKID PLTGFVDPFVWKTIKNHESRKHFLE GFDFLHYDVKTGDFILHFKMNRNLS FQRGLPGFMPAWDIVFEKNETQFDA KGTPFIAGKRIVPVIENHRFTGRYR DLYPANELIALLEEKGIVFRDGSNI LPKLLENDDSHAIDTMVALIRSVLQ MANSNAATGEDYINSPVRDLNGVCF DSRFQNPEWPMDADANGAYHIALKG QLLLNHLKESKDLKLQNGISNQDWL AYIQELRN (SEQ ID NO: 121) |
| LbCas12a (previously known as Cpf1) *Lachnospiraceae bacterium* GAM79 Ref Seq. WP_ 119623382.1 | MNYKTGLEDFIGKESLSKTLRNALI PTESTKIHMEEMGVIRDDELRAEKQ QELKEIMDDYYRTFIEEKLGQIQGI QWNSLFQKMEETMEDISVRKDLDKI QNEKRKEICCYFTSDKRFKDLFNAK LITDILPNFIKDNKEYTEEEKAEKE QTRVLFQRFATAFTNYFNQRRNNFS EDNISTAISFRIVNENSEIHLQNMR AFQRIEQQYPEEVCGMEEEYKDMLQ EWQMKHIYSVDFYDRELTQPGIEYY NGICGKINEHMNQFCQKNRINKNDF RMKKLHKQILCKKSSYYEIPFRFES DQEVYDALNEFIKTMKKKEIIRRCV HLGQECDDYDLGKIYISSNKYEQIS NALYGSWDTIRKCIKEEYMDALPGK GEKKEEKAEAAAKKEEYRSIADIDK IISLYGSEMDRTISAKKCITEICDM AGQISIDPLVCNSDIKLLQNKEKTT EIKTILDSFLHVYQWGQTFIVSDII EKDSYFYSELEDVLEDFEGITTLYN HVRSYVTQKPYSTVKFKLHFGSPTL ANGWSQSKEYDNNAILLMRDQKFYL GIFNVRNKPDKQIIKGHEKEEKGDY KKMIYNLLPGPSKMLPKVFITSRSG QETYKPSKHILDGYNEKRHIKSSPK FDLGYCWDLIDYYKECIHKHPDWKN YDFHFSDTKDYEDISGFYREVEMQG YQIKWTYISADEIQKLDEKGQIFLF QIYNKDFSVHSTGKDNLHTMYLKNL FSEENLKDIVLKLNGEAELFFRKAS IKTPIVHKKGSVLVNRSYTQTVGNK EIRVSIPEEYYTEIYNYLNHIGKGK LSSEAQRYLDEGKIKSFTATKDIVK NYRYCCDHYFLHLPITINFKAKSDV AVNERTLAYIAKKEDIHIIGIDRGE RNLLYISVVDVHGNIREQRSFNIVN GYDYQQKLKDREKSRDAARKNWEEI EKIKELKEGYLSMVIHYIAQLVVKY NAVVAMEDLNYGFKTGRFKVERQVY QKFETMLIEKLHYLVFKDREVCEEG GVLRGYQLTYIPESLKKVGKQCGFI FYVPAGYTSKIDPTTGFVNLFSFKN LTNRESRQDFVGKFDEIRYDRDKKM FEFSFDYNNYIKKGTILASTKWKVY TNGTRLKRIVVNGKYTSQSMEVELT DAMEKMLQRAGIEYHDGKDLKGQIV EKGIEAEIIDIFRLTVQMRNSRSES EDREYDRLISPVLNDKGEFFDTATA DKTLPQDADANGAYCIALKGLYEVK QIKENWKENEQFPRNKLVQDNKTWF DFMQKKRYL (SEQ ID NO: 122) |
| PcCas12a- previously known at Cpf1 *Prevotella copri* Ref Seq. WP_ 119227726.1 | MAKNFEDFKRLYSLSKTLRFEAKPI GATLDNIVKSGLLDEDEHRAASYVK VKKLIDEYHKVFIDRVLDDGCLPLE NKGNNNSLAEYYESYVSRAQDEDAK KKFKEIQQNLRSVIAKKLTEDKAYA NLFGNKLIESYKDKEDKKKIIDSDL IQFINTAESTQLDSMSQDEAKELVK EFWGFVTYFYGFFDNRKNMYTAEEK STGIAYRLVNENLPKFIDNIEAFNR AITRPEIQENMGVLYSDFSEYLNVE |

-continued

| Description | Sequence |
|---|---|
| | SIQEMFQLDYYNMLLTQKQIDVYNA IIGGKTDDEHDVKIKGINEYINLYN QQHKDDKLPKLKALFKQILSDRNAI SWLPEEFNSDQEVLNAIKDCYERLA ENVLGDKVLKSLLGSLADYSLDGIF IRNDLQLTDISQKMFGNWGVIQNAI MQNIKRVAPARKHKESEEDYEKRIA GIFKKADSFSISYINDCLNEADPNN AYFVENYFATFGAVNTPTMQRENLF ALVQNAYTEVAALLHSDYPTVKHLA QDKANVSKIKALLDAIKSLQHFVKP LLGKGDESDKDERFYGELASLWAEL DTVTPLYNMIRNYMTRKPYSQKKIK LNFENPQLLGGWDANKEKDYATIIL RRNGLYYLAIMDKDSRKLLGKAMPS DGECYEKMVYKFFKDVTTMIPKCST QLKDVQAYFKVNTDDYVLNSKAFNK PLTITKEVFDLNNVLYGKYKKFQKG YLTATGDNVGYTHAVNVWIKFCMDF LNSYDSTCIYDFSSLKPESYLSLDA FYQDANLLLYKLSFARASVSYINQL VEEGKMYLFQIYNKDFSEYSKGTPN MHTLYWKALFDERNLADVVYKLNGQ AEMFYRKKSIENTHPTHPANHPILN KNKDNKKKESLFDYDLIKDRRYTVD KFMFHVPITMNFKSVGSENINQDVK AYLRHADDMHIIGIDRGERHLLYLV VIDLQGNIKEQYSLNEIVNEYNGNT YHTNYHDLLDVREEERLKARQSWQT IENIKELKEGYLSQVIHKITQLMVR YHAIVVLEDLSKGFMRSRQKVEKQV YQKFEKMLIDKLNYLVDKKTDVSTP GGLLNAYQLTCKSDSSQKLGKQSGF LFYIPAWNTSKIDPVTGFVNLLDTH SLNSKEKIKAFFSKFDAIRYNKDKK WFEFNLDYDKFGKKAEDTRTKWTLC TRGMRIDTFRNKEKNSQWDNQEVDL TTEMKSLLEHYYIDIHGNLKDAISA QTDKAFFTGLLHILKLTLQMRNSIT GTETDYLVSPVADENGIFYDSRSCG NQLPENADANGAYNIARKGLMLIEQ IKNAEDLNNVKFDISNKAWLNFAQQ KPYKNG (SEQ ID NO: 123) |
| ErCas12a- previously known at Cpf1 *Eubacterium rectale* Ref Seq. WP_11922364 2.1 | MFSAKLISDILPEFVIHNNNYSASE KEEKTQVIKLFSRFATSFKDYFKNR ANCFSANDISSSSCHRIVNDNAEIF FSNALVYRRIVKNLSNDDINKISGD MKDSLKEMSLEEIYSYEKYGEFITQ EGISFYNDICGKVNLFMNLYCQKNK ENKNLYKLRKLHKQILCIADTSYEV PYKFESDEEVYQSVNGFLDNISSKH IVERLRKIGENYNGYNLDKIYIVSK FYESVSQKTYRDWETINTALEIHYN NILPGNGKSKADKVKKAVKNDLQKS ITEINELVSNYKLCPDDNIKAETYI HEISHILNNFEAQELKYNPEIHLVE SELKASELKNVLDVIMNAFHWCSVF MTEELVDKDNNFYAELEEIYDEIYP VISLYNLVRNYVTQKPYSTKKIKLN FGIPTLADGWSKSKEYSNNAIILMR DNLYYLGIFNAKNKPDKKIIEGNTS ENKGDYKKMIYNLLPGPNKMIPKVF LSSKTGVETYKPSAYILEGYKQNKH LKSSKDFDITFCHDLIDYFKNCIAI HPEWKNFGFDFSDTSTYEDISGFYR EVELQGYKIDWTYISEKDIDLLQEK GQLYLFQIYNKDFSKKSSGNDNLHT MYLKNLFSEENLKDIVLKLNGEAEI FFRKSSIKNPIIHKKGSILVNRTYE AEEKDQFGNIQIVRKTIPENIYQEL YKYFNDKSDKELSDEAAKLKNVVGH HEAATNIVKDYRYTYDKYFLHMPIT INFKANKTSFINDRILQYIAKEKDL HVIGIDRGERNLIYVSVIDTCGNIV EQKSFNIVNGYDYQIKLKQQEGARQ IARKEWKEIGKIKEIKEGYLSLVIH |

-continued

| Description | Sequence |
|---|---|
| | EISKMVIKYNAIIAMEDLSYGFKKG RFKVERQVYQKFETMLINKLNYLVF KDISITENGGLLKGYQLTYIPDKLK NVGHQCGCIFYVPAAYTSKIDPTTG FVNIFKFKDLTVDAKREFIKKFDSI RYDSDKNLFCFTFDYNNFITQNTVM SKSSWSVYTYGVRIKRRFVNGRFSN ESDTIDITKDMEKTLEMTDINWRDG HDLRQDIIDYEIVQHIFEIFKLTVQ MRNSLSELEDRDYDRLISPVLNENN IFYDSAKAGDALPKDADANGAYCIA LKGLYEIKQITENWKEDGKFSRDKL KISNKDWFDFIQNKRYL (SEQ ID NO: 124) |
| CsCas12a- previously known at Cpf1 *Clostridium* sp. AF34- 10BH Ref Seq. WP_ 118538418.1 | MNYKTGLEDFIGKESLSKTLRNALI PTESTKIHMEEMGVIRDDELRAEKQ QELKEIMDDYYRAFIEEKLGQIQGI QWNSLFQKMEETMEDISVRKDLDKI QNEKRKEICCYFTSDKRFKDLFNAK LITDILPNFIKDNKEYTEEEKAEKE QTRVLFQRFATAFTNYFNQRRNNFS EDNISTAISFRIVNENSEIHLQNMR AFQRIEQQYPEEVCGMEEEYKDMLQ EWQMKHIYLVDFYDRVLTQPGIEYY NGICGKINEHMNQFCQKNRINKNDF RMKKLHKQILCKKSSYYEIPFRFES DQEVYDALNEFIKTMKEKEIICRCV HLGQKCDDYDLGKIYISSNKYEQIS NALYGSWDTIRKCIKEEYMDALPGK GEKKEEKAEAAAKKEEYRSIADIDK IISLYGSEMDRTISAKKCITEICDM AGQISTDPLVCNSDIKLLQNKEKTT EIKTILDSFLHVYQWGQTFIVSDII EKDSYFYSELEDVLEDFEGITTLYN HVRSYVTQKPYSTVKFKLHFGSPTL ANGWSQSKEYDNNAILLMRDQKFYL GIFNVRNKPDKQIIKGHEKEEKGDY KKMIYNLLPGPSKMLPKVFITSRSG QETYKPSKHILDGYNEKRHIKSSPK FDLGYCWDLIDYYKECIHKHPDWKN YDFHFSDTKDYEDISGFYREVEMQG YQIKWTYISADEIQKLDEKGQIFLF QIYNKDFSVHSTGKDNLHTMYLKNL FSEENLKDIVLKLNGEAELFFRKAS IKTPVVHKKGSVLVNRSYTQTVGDK EIRVSIPEEYYTEIYNYLNHIGRGK LSTEAQRYLEERKIKSFTATKDIVK NYRYCCDHYFLHLPITINFKAKSDI AVNERTLAYIAKKEDIHIIGIDRGE RNLLYISVVDVHGNIREQRSFNIVN GYDYQQKLKDREKSRDAARKNWEEI EKIKELKEGYLSMVIHYIAQLVVKY NAVVAMEDLNYGFKTGRFKVERQVY QKFETMLIEKLHYLVFKDREVCEEG GVLRGYQLTYIPESLKKVGKQCGFI FYVPAGYTSKIDPTTGFVNLFSFKN LTNRESRQDFVGKFDEIRYDRDKKM FEFSFDYNNYIKKGTMLASTKWKVY TNGTRLKRIVVNGKYTSQSMEVELT DAMEKMLQRAGIEYHDGKDLKGQIV EKGIEAEIIDIFRLTVQMRNSRSES EDREYDRLISPVLNDKGEFFDTATA DKTLPQDADANGAYCIALKGLYEVK QIKENWKENEQFPRNKLVQDNKTWF DFMQKKRYL (SEQ ID NO: 125) |
| BhCas12b *Bacillus hisashii* Ref Seq. WP_ 095142515.1 | MATRSFILKIEPNEEVKKGLWKTHE VLNHGIAYYMNILKLIRQEAIYEHH EQDPKNPKKVSKAEIQAELWDFVLK MQKCNSFTHEVDKDEVFNILRELYE ELVPSSVEKKGEANQLSNKFLYPLV DPNSQSGKGTASSGRKPRWYNLKIA GDPSWEEEKKKWEEDKKKDPLAKIL GKLAEYGLIPLFIPYTDSNEPIVKE IKWMEKSRNQSVRRLDKDMFIQALE RFLSWESWNLKVKEEYEKVEKEYKT LEERIKEDIQALKALEQYEKERQEQ LLRDTLNTNEYRLSKRGLRGWREII QKWLKMDENEPSEKYLEVFKDYQRK HPREAGDYSVYEFLSKKENHFIWRN HPEYPYLYATFCEIDKKKKDAKQQA TFTLADPINHPLWVRFEERSGSNLN KYRILTEQLHTEKLKKKLTVQLDRL IYPTESGGWEEKGKVDIVLLPSRQF YNQIFLDIEEKGKHAFTYKDESIKF PLKGTLGGARVQFDRDHLRRYPHKV ESGNVGRIYFNMTVNIEPTESPVSK SLKIHRDDFPKVVNFKPKELTEWIK DSKGKKLKSGIESLEIGLRVMSIDL GQRQAAAASIFEVVDQKPDIEGKLF FPIKGTELYAVHRASFNIKLPGETL VKSREVLRKAREDNLKLMNQKLNFL RNVLHFQQFEDITEREKRVTKWISR QENSDVPLVYQDELIQIRELMYKPY KDWVAFLKQLHKRLEVEIGKEVKHW RKSLSDGRKGLYGISLKNIDEIDRT RKFLLRWSLRPTEPGEVRRLEPGQR FAIDQLNHLNALKEDRLKKMANTII MHALGYCYDVRKKKWQAKNPACQII LFEDLSNYNPYEERSRFENSKLMKW SRREIPRQVALQGEIYGLQVGEVGA QFSSRFHAKTGSPGIRCSVVTKEKL QDNRFFKNLQREGRLTLDKIAVLKE GDLYPDKGGEKFISLSKDRKCVTTH ADIMAAQNLQKRFWTRTHGFYKVYC KAYQVDGQTVYIPESKDQKQKIIEE FGEGYFILKDGVYEWVNAGKLKIKK GSSKQSSSELVDSDILKDSFDLASE LKGEKLMLYRDPSGNVFPSDKWMAA GVFFGKLERILISKLTNQYSISTIE DDSSKQSM (SEQ ID NO: 126) |
| ThCas12b *Thermomonas hydrothermalis* Ref Seq. WP_ 072754838 | MSEKTTQRAYTLRLNRASGECAVCQ NNSCDCWHDALWATHKAVNRGAKAF GDWLLTLRGGLCHTLVEMEVPAKGN NPPQRPTDQERRDRRVLLALSWLSV EDEHGAPKEFIVATGRDSADDRAKK VEEKLREILEKRDFQEHEIDAWLQD CGPSLKAHIREDAVWVNRRALFDAA VERIKTLTWEEAWDFLEPFFGTQYF AGIGDGKDKDDAEGPARQGEKAKDL VQKAGQWLSARFGIGTGADFMSMAE AYEKIAKWASQAQNGDNGKATIEKL ACALRPSEPPTLDTVLKCISGPGHK SATREYLKTLDKKSTVTQEDLNQLR KLADEDARMCRKKVGKKGKKPWADE VLKDVENSCELTYLQDNSPARHREF SVMLDHAARRVSMAHSWIKKAEQRR RQFESDAQKLKNLQERAPSAVEWLD RFCESRSMTTGANTGSGYRIRKRAI EGWSYVVQAWAEASCDTEDKRIAAA RKVQADPEIEKFGDIQLFEALAADE AICVWRDQEGTQNPSILIDYVTGKT AEHNQKRFKVPAYRHPDELRHPVFC DFGNSRWSIQFAIHKEIRDRDKGAK QDTRQLQNRHGLKMRLWNGRSMTDV NLHWSSKRLTADLALDQNPNPNPTE VTRADRLGRAASSAFDHVKIKNVFN EKEWNGRLQAPRAELDRIAKLEEQG KTEQAEKLRKRLRWYVSFSPCLSPS GPFIVYAGQHNIQPKRSGQYAPHAQ ANKGRARLAQLILSRLPDLRILSVD LGHRFAAACAVWETLSSDAFRREIQ GLNVLAGGSGEGDLFLHVEMTGDDG KRRTVVYRRIGPDQLLDNTPHPAPW ARLDRQFLIKLQGEDEGVREASNEE LWTVHKLEVEVGRTVPLIDRMVRSG FGKTEKQKERLKKLRELGWISAMPN EPSAETDEKEGEIRSISRSVDELMS SALGTLRLALKRHGNRARIAFAMTA DYKPMPGGQKYYFHEAKEASKNDDE |

-continued

| Description | Sequence |
|---|---|
| | TKRRDNQIEFLQDALSLWHDLFSSP<br>DWEDNEAKKLWQNHIATLPNYQTPE<br>EISAELKRVERNKKRKENRDKLRTA<br>AKALAENDQLRQHLHDTWKERWESD<br>DQQWKERLRSLKDWIFPRGKAEDNP<br>SIRHVGGLSITRINTISGLYQILKA<br>FKMRPEPDDLRKNIPQKGDDELENF<br>NRRLLEARDRLREQRVKQLASRIIE<br>AALGVGRIKIPKNGKLPKRPRTTVD<br>TPCHAVVIESLKTYRPDDLRTRREN<br>RQLMQWSSAKVRKYLKEGCELYGLH<br>FLEVPANYTSRQCSRTGLPGIRCDD<br>VPTGDFLKAPWWRRAINTAREKNGG<br>DAKDRFLVDLYDHLNNLQSKGEALP<br>ATVRVPRQGGNLFIAGAQLDDTNKE<br>RRAIQADLNAAANIGLRALLDPDWR<br>GRWWYVPCKDGTSEPALDRIEGSTA<br>FNDVRSLPTGDNSSRRAPREIENLW<br>RDPSGDSLESGTWSPTRAYWDTVQS<br>RVIELLRRHAGLPTS<br>(SEQ ID NO: 127) |
| LsCas12b<br>*Laceyella*<br>*sacchari*<br>WP_<br>132221894.1 | MSIRSFKLKLKTKSGVNAEQLRRGL<br>WRTHQLINDGIAYYMNWLVLLRQED<br>LFIRNKETNEIEKRSKEEIQAVLLE<br>RVHKQQQRNQWSGEVDEQTLLQALR<br>QLYEEIVPSVIGKSGNASLKARFFL<br>GPLVDPNNKTTKDVSKSGPTPKWKK<br>MKDAGDPNWVQEYEKYMAERQTLVR<br>LEEMGLIPLFPMYTDEVGDIHWLPQ<br>ASGYTRTWDRDMF<br>QQAIERLLSWESWNRRVRERRAQFE<br>KKTHDFASRFSESDVQWMNKLREYE<br>AQQEKSLEENAFAPNEPYALTKKAL<br>RGWERVYHSWMRLDSAASEEAYWQE<br>VATCQTAMRGEFGDPAIYQFLAQKE<br>NHDIWRGYPERVIDFAELNHLQREL<br>RRAKEDATFTLPDSVDHPLWVRYEA<br>PGGTNIHGYDLVQDTKRNLTLILDK<br>FILPDENGSWHEVKKVPFSLAKSKQ<br>FHRQVWLQEEQKQKKREVVFYDYST<br>NLPHLGTLAGAKLQWDRNFLNKRTQ<br>QQIEETGEIGKVFFNISVDVRPAVE<br>VKNGRLQNGLGKALTVLTHPDGTKI<br>VTGWKAEQLEKWVGESGRVSSLGLD<br>SLSEGLRVMSIDLGQRTSATVSVFE<br>ITKEAPDNPYKFFYQLEGTEMFAVH<br>QRSFLLALPGENPPQKIKQMREIRW<br>KERNRIKQQVDQLSAILRLHKKVNE<br>DERIQAIDKLLQKVASWQLNEEIAT<br>AWNQALSQLYSKAKENDLQWNQAIK<br>MAHHQLEPVVGKQISLWRKDLSTGR<br>QGIAGLSLWSIEELEATKKLLTRVV<br>SKRSREPGWKRIERFETFAKQIQHH<br>INQVKENRLKQLANLIVMTALGYKY<br>DQEQKKWIEVYPACQVVLFENLRSY<br>RFSFERSRRENKKLMEWSHRSIPKL<br>VQMQGELFGLQVADVYAAYSSRYHG<br>RTGAPGIRCHALTEADLRNETNIIH<br>ELIEAGFIKEEHRPYLQQGDLVPWS<br>GGELFATLQKPYDNPRILTLHADIN<br>AAQNIQKRFWHPSMWFRVNCESVME<br>GEIVTYVPKNKTVHKKQGKTFRFVK<br>VEGSDVYEWAKWSKNRNKNTFSSIT<br>ERKPPSSMILFRDPSGTFFKEQEWV<br>EQKTFWGKVQSMIQAYMKKTIVRQR<br>MEE (SEQ ID NO: 128) |
| DtCas12b<br>*Dsulfonatronum*<br>*thiodismutans*<br>WP_<br>031386437 | MVLGRKDDTAELRRALWTTHEHVNL<br>AVAEVERVLLRCRGRSYWTLDRRGD<br>PVHVPESQVAEDALAMAREAQRRNG<br>WPVVGEDEEILLALRYLYEQIVPSC<br>LLDDLGKPLKGDAQKIGTNYAGPLF<br>DSDTCRRDEGKDVACCGPFHEVAGK<br>YLGALPEWATPISKQEFDGKDASHL<br>RFKATGGDDAFFRVSIEKANAWYED<br>PANQDALKNKAYNKDDWKKEKDKGI |

-continued

| Description | Sequence |
|---|---|
| | SSWAVKYIQKQLQLGQDPRTEVRRK<br>LWLELGLLPLFIPVFDKTMVGNLWN<br>RLAVRLALAHLLSWESWNHRAVQDQ<br>ALARAKRDELAALFLGMEDGFAGLR<br>EYELRRNESIKQHAFEPVDRPYVVS<br>GRALRSWTRVREEWLRHGDTQESRK<br>NICNRLQDRLRGKFGDPDVFHWLAE<br>DGQEALWKERDCVTSFSLLNDADGL<br>LEKRKGYALMTFADARLHPRWAMYE<br>APGGSNLRTYQIRKTENGLWADVVL<br>LSPRNESAAVEEKTFNVRLAPSGQL<br>SNVSFDQIQKGSKMVGRCRYQSANQ<br>QFEGLLGGAEILFDRKRIANEQHGA<br>TDLASKPGHVWFKLTLDVRPQAPQG<br>WLDGKGRPALPPEAKHFKTALSNKS<br>KFADQVRPGLRVLSVDLGVRSFAAC<br>SVFELVRGGPDQGTYFPAADGRTVD<br>DPEKLWAKHERSFKITLPGENPSRK<br>EEIARRAAMEELRSLNGDIRRLKAI<br>LRLSVLQEDDPRTEHLRLFMEAIVD<br>DPAKSALNAELFKGFGDDRFRSTPD<br>LWKQHCHFFHDKAEKVVAERFSRWR<br>TETRPKSSSWQDWRERRGYAGGKSY<br>WAVTYLEAVRGLILRWNMRGRTYGE<br>VNRQDKKQFGTVASALLHHINQLKE<br>DRIKTGADMIIQAARGFVPRKNGAG<br>WVQVHEPCRLILFEDLARYRFRTDR<br>SRRENSRLMRWSHREIVNEVGMQGE<br>LYGLHVDTTEAGFSSRYLASSGAPG<br>VRCRHLVEEDFHDGLPGMHLVGELD<br>WLLPKDKDRTANEARRLLGGMVRPG<br>MLVPWDGGELFATLNAASQLHVIHA<br>DINAAQNLQRRFWGRCGEAIRIVCN<br>QLSVDGSTRYEMAKAPKARLLGALQ<br>QLKNGDAPFHLTSIPNSQKPENSYV<br>MTPTNAGKKYRAGPGEKSSGEEDEL<br>ALDIVEQAEELAQGRKTFFRDPSGV<br>FFAPDRWLPSEIYWSRIRRRIWQVT<br>LERNSSGRQERAEMDEMPY<br>(SEQ ID NO:129) |

The napDNAbp domains of the split nucleobase editors described herein may also comprise Cas12a/Cpf1 (dCpf1) variants that may be used as a guide nucleotide sequence-programmable DNA-binding protein domain. The Cas12a/Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity.

In some embodiments, the napDNAbp is a nucleic acid programmable DNA binding protein that does not require a canonical (NGG) PAM sequence. In some embodiments, the napDNAbp is an argonaute protein. In some embodiments, the disclosure provides napDNAbp domains that comprise SpCas9 variants that recognize and work best with NRRH, NRCH, and NRTH PAMs. See PCT Application No. PCT/US2019/47996, incorporated by reference herein. In some embodiments, the disclosed base editors comprise a napDNAbp domain selected from SpCas9-NRRH, SpCas9-NRTH, and SpCas9-NRCH.

In some embodiments, the disclosed base editors comprise a napDNAbp domain that has a sequence that is at least 90%, at least 95%, at least 98%, or at least 99% identical to SpCas9-NRRH. In some embodiments, the disclosed base editors comprise a napDNAbp domain that comprises SpCas9-NRRH. The SpCas9-NRRH has an amino acid sequence as presented in SEQ ID NO: 435 (underligned residues are mutated relative to SpCas9, as set forth in SEQ ID NO: 1)

(SEQ ID NO: 435)
MDKKYSIGLDIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMVKRYDEHHQDLTLLKALVRQQLPEKYKEI
FFDQSKNGYAGYIDGGASQEEFYKFIKPILEKMDG
TEELLVKLNREDLLRKQRTFDNGIIPHQIHLGELH
AILRRQGDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRLRYTGWGRLSRK
LINGIRDKQSGKTILDFLKSDGFANRNFMQLIHDD
SLTFKEDIQKAQVSGQGDSLHEHIANLAGSPAIKK
GILQTVKVVDELVKVMGGHKPENIVIEMARENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESILPKGNSDKLI
ARKKDWDPKKYGGFNSPTAAYSVLVVAKVEKGKSK
KLKSVKELLGITIMERSSFEKNPIGFLEAKGYKEV
KKDLIIKLPKYSLFELENGRKRMLASAGVLHKGNE
LALPSKYVNFLYLASHYEKLKGSPEDNEQKQLFVE
QHKHYLDEIIEQISEFSKRVILADANLDKVLSAYN

-continued

KHRDKPIREQAENIIHLFTLTNLGVPAAFKYFDTT
IDKKRYTSTKEVLDATLIHQSITGLYETRIDLSQL
GGD.

In some embodiments, the disclosed base editors comprise a napDNAbp domain that has a sequence that is at least 90%, at least 95%, at least 98%, or at least 99% identical to SpCas9-NRCH. In some embodiments, the disclosed base editors comprise a napDNAbp domain that comprises SpCas9-NRCH. The SpCas9-NRCH has an amino acid sequence as presented in SEQ ID NO: 436 (underligned residues are mutated relative to SpCas9)

(SEQ ID NO: 436)
MDKKYSIGLDIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMVKRYDEHHQDLTLLKALVRQQLPEKYKEI
FFDQSKNGYAGYIDGGASQEEFYKFIKPILEKMD
GTEELLVKLNREDLLRKQRTFDNGIIPHQIHLGEL
HAILRRQGDFYPFLKDNREKIEKILTFRIPYYVGP
LARGNSRFAWMTRKSEETITPWNFEEVVDKGASAQ
SFIERMTNFDKNLPNEKVLPKHSLLYEYFTVYNEL
TKVKYVTEGMRKPAFLSGEQKKAIVDLLFKTNRKV
TVKQLKEDYFKKIECFDSVEISGVEDRFNASLGTY
HDLLKIIKDKDFLDNEENEDILEDIVLTLTLFEDR
EMIEERLKTYAHLFDDKVMKQLKRLRYTGWGRLSR
KLINGIRDKQSGKTILDFLKSDGFANRNFMQLIHD
DSLTFKEDIQKAQVSGQGDSLHEHIANLAGSPAIK
KGILQTVKVVDELVKVMGGHKPENIVIEMARENQT
TQKGQKNSRERMKRIEEGIKELGSQILKEHPVENT
QLQNEKLYLYYLQNGRDMYVDQELDINRLSDYDVD
HIVPQSFLKDDSIDNKVLTRSDKNRGKSDNVPSEE
VVKKMKNYWRQLLNAKLITQRKFDNLTKAERGGLS
ELDKAGFIKRQLVETRQITKHVAQILDSRMNTKYD
ENDKLIREVKVITLKSKLVSDFRKDFQFYKVREIN
NYHHAHDAYLNAVVGTALIKKYPKLESEFVYGDYK
VYDVRKMIAKSEQEIGKATAKYFFYSNIMNFFKTE
ITLANGEIRKRPLIETNGETGEIVWDKGRDFATVR

-continued

KVLSMPQVNIVKKTEVQTGGFSKESILPKGNSDKL

IARKKDWDPKKYGGFNSPTVAYSVLVVAKVEKGKS

KKLKSVKELLGITIMERSSFEKNPIDFLEAKGYKE

VKKDLIIKLPKYSLFELENGRKRMLASAGVLQKGN

ELALPSKYVNFLYLASHYEKLKGSPEDNEQKQLFV

EQHKHYLDEIIEQISEFSKRVILADANLDKVLSAY

NKHRDKPIREQAENIIHLFTLTNLGAPAAFKYFDT

TINRKQYNTTKEVLDATLIRQSITGLYETRIDLSQ

LGGD

In some embodiments, the disclosed base editors comprise a napDNAbp domain that has a sequence that is at least 90%, at least 95%, at least 98%, or at least 99% identical to SpCas9-NRTH. In some embodiments, the disclosed base editors comprise a napDNAbp domain that comprises SpCas9-NRTH. The SpCas9-NRTH has an amino acid sequence as presented in SEQ ID NO: 437 (underligned residues are mutated relative to SpCas9)

(SEQ ID NO: 437)

MDKKYSIGLDIGTNSVGWAVITDEYKVPSKKFKVL

GNTDRHSIKKNLIGALLFDSGETAEATRLKRTARR

RYTRRKNRICYLQEIFSNEMAKVDDSFFHRLEESF

LVEEDKKHERHPIFGNIVDEVAYHEKYPTIYHLRK

KLVDSTDKADLRLIYLALAHMIKFRGHFLIEGDLN

PDNSDVDKLFIQLVQTYNQLFEENPINASGVDAKA

ILSARLSKSRRLENLIAQLPGEKKNGLFGNLIALS

LGLTPNFKSNFDLAEDAKLQLSKDTYDDDLDNLLA

QIGDQYADLFLAAKNLSDAILLSDILRVNTEITKA

PLSASMVKRYDEHHQDLTLLKALVRQQLPEKYKEI

FFDQSKNGYAGYIDGGASQEEFYKFIK PILEKMD

GTEELLVKLNREDLLRKQRTFDNGIIPHQIHLGEL

HAILRRQGDFYPFLKDNREKIEKILTFRIPYYVGP

LARGNSRFAWMTRKSEETITPWNFEEVVDKGASAQ

SFIERMTNFDKNLPNEKVLPKHSLLYEYFTVYNEL

TKVKYVTEGMRKPAFLSGEQKKAIVDLLFKTNRKV

TVKQLKEDYFKKIECFDSVEISGVEDRFNASLGTY

HDLLKIIKDKDFLDNEENEDILEDIVLTLTLFEDR

EMIEERLKTYAHLFDDKVMKQLKRLRYTGWGRLSR

KLINGIRDKQSGKTILDFLKSDGFANRNFMQLIHD

DSLTFKEDIQKAQVSGQGDSLHEHIANLAGSPAIK

KGILQTVKVVDELVKVMGGHKPENIVIEMARENQT

TQKGQKNSRERMKRIEEGIKELGSQILKEHPVENT

QLQNEKLYLYYLQNGRDMYVDQELDINRLSDYDVD

HIVPQSFLKDDSIDNKVLTRSDKNRGKSDNVPSEE

-continued

VVKKMKNYWRQLLNAKLITQRKFDNLTKAERGGLS

ELDKAGFIKRQLVETRQITKHVAQILDSRMNTKYD

ENDKLIREVKVITLKSKLVSDFRKDFQFYKVREIN

NYHHAHDAYLNAVVGTALIKKYPKLESEFVYGDYK

VYDVRKMIAKSEQEIGKATAKYFFYSNIMNFFKTE

ITLANGEIRKRPLIETNGETGEIVWDKGRDFATVR

KVLSMPQVNIVKKTEVQTGGFSKESILPKGNSDKL

IARKKDWDPKKYGGFNSPTVAYSVLVVAKVEKGKS

KKLKSVKELLGITIMERSSFEKNPIGFLEAKGYKE

VKKDLIIKLPKYSLFELENGRKRMLASASVLHKGN

ELALPSKYVNFLYLASHYEKLKGSSEDNKQKQLFV

EQHKHYLDEIIEQISEFSKRVILADANLDKVLSAY

NKHRDKPIREQAENIIHLFTLTNLGASAAFKYFDT

TIGRKLYTSTKEVLDATLIHQSITGLYETRIDLSQ

LGGD

The napDNAbp domains of the split nucleobase editors of the present disclosure may also comprise Cas9 variants with modified PAM specificities. Some aspects of this disclosure provide Cas9 proteins that exhibit activity on a target sequence that does not comprise the canonical PAM (5'-NGG-3', where N is A, C, G, or T) at its 3'-end. In some embodiments, the Cas9 protein exhibits activity on a target sequence comprising a 5'-NGG-3' PAM sequence at its 3'-end. In some embodiments, the Cas9 protein exhibits activity on a target sequence comprising a 5"-NNG-3" PAM sequence at its 3'-end. In some embodiments, the Cas9 protein exhibits activity on a target sequence comprising a 5'-NNA-3' PAM sequence at its 3'-end. In some embodiments, the Cas9 protein exhibits activity on a target sequence comprising a 5'-NNC-3' PAM sequence at its 3'-end. In some embodiments, the Cas9 protein exhibits activity on a target sequence comprising a 5"-NNT-3" PAM sequence at its 3'-end. In some embodiments, the Cas9 protein exhibits activity on a target sequence comprising a 5"-NGT-3" PAM sequence at its 3'-end. In some embodiments, the Cas9 protein exhibits activity on a target sequence comprising a 5"-NGA-3" PAM sequence at its 3'-end. In some embodiments, the Cas9 protein exhibits activity on a target sequence comprising a 5'-NGC-3' PAM sequence at its 3'-end. In some embodiments, the Cas9 protein exhibits activity on a target sequence comprising a 5"-NAA-3" PAM sequence at its 3"-end. In some embodiments, the Cas9 protein exhibits activity on a target sequence comprising a 5"-NAC-3' PAM sequence at its 3'-end. In some embodiments, the Cas9 protein exhibits activity on a target sequence comprising a 5"-NAT-3" PAM sequence at its 3"-end. In still other embodiments, the Cas9 protein exhibits activity on a target sequence comprising a 5"-NAG-3' PAM sequence at its 3"-end.

In some embodiments, the disclosed adenine base editors comprise a napDNAbp domain comprising a SpCas9-NG, which has a PAM that corresponds to NGN. In some embodiments, the disclosed base editors comprise a napDNAbp domain that has a sequence that is at least 90%, at least 95%, at least 98%, or at least 99% identical to SpCas9-NG. The sequence of SpCas9-NG is illustrated below:

(SEQ ID NO: 554)
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFMQLIHDD
SLTFKEDIQKAQVSGQGDSLHEHIANLAGSPAIKK
GILQTVKVVDELVKVMGRHKPENIVIEMARENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESIRPKRNSDKLI
ARKKDWDPKKYGGFVSPTVAYSVLVVAKVEKGKSK
KLKSVKELLGITIMERSSFEKNPIDFLEAKGYKEV
KKDLIIKLPKYSLFELENGRKRMLASARFLQKGNE
LALPSKYVNFLYLASHYEKLKGSPEDNEQKQLFVE
QHKHYLDEIIEQISEFSKRVILADANLDKVLSAYN
KHRDKPIREQAENIIHLFTLTNLGAPRAFKYFDTT
IDRKVYRSTKEVLDATLIHQSITGLYETRIDLSQL
GGD

In some embodiments, the disclosed base editors comprise a napDNAbp domain comprising a SaCas9-KKH, which has a PAM that corresponds to NNNRRT. In some embodiments, the disclosed base editors comprise a napDNAbp domain that has a sequence that is at least 90%, at least 95%, at least 98%, or at least 99% identical to SaCas9-KKH. The sequence of SaCas9-KKH is illustrated below:

*S. aureus* Cas9 nickase KKH (D10A/E782K/N968K/R1015H) (SaCas9-KKH)

(SEQ ID NO: 555)
MGKRNYILGLAIGITSVGYGIIDYETRDVIDAGVR
LFKEANVENNEGRRSKRGARRLKRRRRHRIQRVKK
LLFDYNLLTDHSELSGINPYEARVKGLSQKLSEEE
FSAALLHLAKRRGVHNVNEVEEDTGNELSTKEQIS
RNSKALEEKYVAELQLERLKKDGEVRGSINRFKTS
DYVKEAKQLLKVQKAYHQLDQSFIDTYIDLLETRR
TYYEGPGEGSPFGWKDIKEWYEMLMGHCTYFPEEL
RSVKYAYNADLYNALNDLNNLVITRDENEKLEYYE
KFQIIENVFKQKKKPTLKQIAKEILVNEEDIKGYR
VTSTGKPEFTNLKVYHDIKDITARKEIIENAELLD
QIAKILTIYQSSEDIQEELTNLNSELTQEEIEQIS
NLKGYTGTHNLSLKAINLILDELWHTNDNQIAIFN
RLKLVPKKVDLSQQKEIPTTLVDDFILSPVVKRSF
IQSIKVINAIIKKYGLPNDIIIELAREKNSKDAQK
MINEMQKRNRQTNERIEEIIRTTGKENAKYLIEKI
KLHDMQEGKCLYSLEAIPLEDLLNNPFNYEVDHII
PRSVSFDNSFNNKVLVKQEENSKKGNRTPFQYLSS
SDSKISYETFKKHILNLAKGKGRISKTKKEYLLEE
RDINRFSVQKDFINRNLVDTRYATRGLMNLLRSYF
RVNNLDVKVKSINGGFTSFLRRKWKFKKERNKGYK
HHAEDALIIANADFIFKEWKKLDKAKKVMENQMFE
EKQAESMPEIETEQEYKEIFITPHQIKHIKDFKDY
KYSHRVDKKPNRKLINDTLYSTRKDDKGNTLIVNN
LNGLYDKDNDKLKKLINKSPEKLLMYHHDPQTYQK
LKLIMEQYGDEKNPLYKYYEETGNYLTKYSKKDNG
PVIKKIKYYGNKLNAHLDITDDYPNSRNKVVKLSL
KPYRFDVYLDNGVYKFVTVKNLDVIKKENYYEVNS
KCYEEAKKLKKISNQAEFIASFYKNDLIKINGELY
RVIGVNNDLLNRIEVNMIDITYREYLENMNDKRPP
HIIKTIASKTQSIKKYSTDILGNLYEVKSKKHPQI
IKKG

In some embodiments, the disclosed adenine base editors comprise a napDNAbp domain comprising a xCas9, an evolved variant of SpCas9. In some embodiments, the disclosed base editors comprise a napDNAbp domain that has a sequence that is at least 90%, at least 95%, at least 98%, or at least 99% identical to xCas9. The sequence of xCas9 is illustrated below:

(SEQ ID NO: 556)

```
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDTKLQLSKDTYDDDLDNLLA
QIGDQYADLFLAAKNLSDAILLSDILRVNTEITKA
PLSASMIKLYDEHHQDLTLLKALVRQQLPEKYKEI
FFDQSKNGYAGYIDGGASQEEFYKFIKPILEKMDG
TEELLVKLNREDLLRKQRTFDNGIIPHQIHLGELH
AILRRQEDFYPFLKDNREKIEKILTFRIPYYVGPL
ARGNSRFAWMTRKSEETITPWNFEKVVDKGASAQS
FIERMTNFDKNLPNEKVLPKHSLLYEYFTVYNELT
KVKYVTEGMRKPAFLSGDQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFIQLIHDD
SLTFKEDIQKAQVSGQGDSLHEHIANLAGSPAIKK
GILQTVKVVDELVKVMGRHKPENIVIEMARENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESILPKRNSDKLI
ARKKDWDPKKYGGFDSPTVAYSVLVVAKVEKGKSK
KLKSVKELLGITIMERSSFEKNPIDFLEAKGYKEV
KKDLIIKLPKYSLFELENGRKRMLASAGVLQKGNE
LALPSKYVNFLYLASHYEKLKGSPEDNEQKQLFVE
QHKHYLDEIIEQISEFSKRVILADANLDKVLSAYN
KHRDKPIREQAENIIHLFTLTNLGAPAAFKYFDTT
```

-continued

```
IDRKRYTSTKEVLDATLIHQSITGLYETRIDLSQL
GGD
```

In various embodiments, the base editors disclosed herein may comprise a circular permutant of Cas9. The term "circularly permuted Cas9" or "circular permutant" of Cas9 or "CP-Cas9") refers to any Cas9 protein, or variant thereof, that occurs or has been modify to engineered as a circular permutant variant, which means the N-terminus and the C-terminus of a Cas9 protein (e.g., a wild type Cas9 protein) have been topically rearranged. Such circularly permuted Cas9 proteins, or variants thereof, retain the ability to bind DNA when complexed with a guide RNA (gRNA). See, Oakes et al., "Protein Engineering of Cas9 for enhanced function," *Methods Enzymol,* 2014, 546: 491-511 and Oakes et al., "CRISPR-Cas9 Circular Permutants as Programmable Scaffolds for Genome Modification," *Cell*, Jan. 10, 2019, 176: 254-267, each of are incorporated herein by reference. The present disclosure contemplates any previously known CP-Cas9 or use a new CP-Cas9 so long as the resulting circularly permuted protein retains the ability to bind DNA when complexed with a guide RNA (gRNA).

In some embodiments, circular permutant Cas9 variants may be defined as a topological rearrangement of a Cas9 primary structure based on the following method, which is based on *S. pyogenes* Cas9 of SEQ ID NO: 1: (a) selecting a circular permutant (CP) site corresponding to an internal amino acid residue of the Cas9 primary structure, which dissects the original protein into an N-terminal portion and a C-terminal portion; (b) modifying the Cas9 protein sequence (e.g., by genetic engineering techniques) by moving the original C-terminal region (comprising the CP site amino acid) to preceed the original N-terminal region, thereby forming a new N-terminus of the Cas9 protein that now begins with the CP site amino acid residue. The CP site can be located in any domain of the Cas9 protein, including, for example, the helical-II domain, the RuvCIII domain, or the CTD domain. For example, the CP site may be located (relative the *S. pyogenes* Cas9 of SEQ ID NO: 1) at original amino acid residue 181, 199, 230, 270, 310, 1010, 1016, 1023, 1029, 1041, 1247, 1249, or 1282. Thus, once relocated to the N-terminus, original amino acid 181, 199, 230, 270, 310, 1010, 1016, 1023, 1029, 1041, 1247, 1249, or 1282 would become the new N-terminal amino acid. Nomenclature of these CP-Cas9 proteins may be referred to as Cas9-$CP^{181}$, Cas9-$CP^{199}$, Cas9-$CP^{230}$, Cas9-CP270, Cas9-$CP^{310}$, Cas9-$CP^{1010}$, Cas9-$CP^{1016}$, Cas9-$CP^{1023}$, Cas9-$CP^{1029}$, cas9-$CP^{1041}$, Cas9-$CP^{1247}$, Cas9-$CP^{1249}$, and Cas9-$CP^{1282}$, respectively. This description is not meant to be limited to making CP variants from SEQ ID NO: 1, but may be implemented to make CP variants in any Cas9 sequence, either at CP sites that correspond to these positions, or at other CP sites entirely. This description is not meant to limit the specific CP sites in any way. Virtually any CP site may be used to form a CP-Cas9 variant.

Exemplary CP-Cas9 amino acid sequences, based on the Cas9 of SEQ ID NO: 1, are provided below in which linker sequences are indicated by underlining and optional methionine (M) residues are indicated in bold. It should be appreciated that the disclosure provides CP-Cas9 sequences that do not include a linker sequence or that include different linker sequences. It should be appreciated that CP-Cas9 sequences may be based on Cas9 sequences other than that of SEQ ID NO: 1 and any examples provided herein are not meant to be limiting. Exemplary CP-Cas9 sequences are as follows:

| CPname | Sequence | SEQ ID NO: |
|---|---|---|
| CP1012 | DYKVYDVRKMIAKSEQEIGKATAKYFFYSNIMNFFKTEITLANGEIRKRPLIETN<br>GETGEIVWDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIMERSSFEK<br>NPIDFLEAKGYKEVKKDLIIKLPKYSLFELENGRKRMLASAGELQKGNELALPSK<br>YVNFLYLASHYEKLKGSPEDNEQKQLFVEQHKHYLDEIIEQISEFSKRVILADAN<br>LDKVLSAYNKHRDKPIREQAENIIHLFTLTNLGAPAAFKYFDTTIDRKRYTSTKE<br>VLDATLIHQSITGLYETRIDLSQLGGDGGSGGSGGSGGSGGSGGSGGDKKYSIGL<br>AIGTNSVGWAVITDEYKVPSKKFKVLGNTDRHSIKKNLIGALLFDSGETAEATRL<br>KRTARRRYTRRKNRICYLQEIFSNEMAKVDDSFFHRLEESFLVEEDKKHERHPIF<br>GNIVDEVAYHEKYPTIYHLRKKLVDSTDKADLRLIYLALAHMIKFRGHFLIEGDL<br>NPONSDVDKLFIQLVQTYNQLFEENPINASGVDAKAILSARLSKSRRLENLIAQL<br>PGEKKNGLFGNLIALSLGLTPNFKSNFDLAEDAKLQLSKDTYDDDLDNLLAQIGD<br>QYADLFLAAKNLSDAILLSDILRVNTEITKAPLSASMIKRYDEHHQDLTLLKALV<br>RQQLPEKYKEIFFDQSKNGYAGYIDGGASQEEFYKFIKPILEKMDGTEELLVKLN<br>REDLLRKQRTFDNGSIPHQIHLGELHAILRRQEDFYPFLKDNREKIEKILTFRIP<br>YYVGPLARGNSRFAWMTRKSEETITPWNFEEVVDKGASAQSFIERMTNFDKNLPN<br>EKVLPKHSLLYEYFTVYNELTKVKYVTEGMRKPAFLSGEQKKAIVDLLFKTNRKV<br>TVKQLKEDYFKKIECFDSVEISGVEDRFNASLGTYHDLLKIIKDKDFLDNEENED<br>ILEDIVLTLTLFEDREMIEERLKTYAHLFDDKVMKQLKRRRYTGWGRLSRKLING<br>IRDKQSGKTILDFLKSDGFANRNFMQLIHDDSLTFKEDIQKAQVSGQGDSLHEHI<br>ANLAGSPAIKKGILQTVKVVDELVKVMGRHKPENIVIEMARENQTTQKGQKNSRE<br>RMKRIEEGIKELGSQILKEHPVENTQLQNEKLYLYYLQNGRDMYVDQELDINRLS<br>DYDVDHIVPQSFLKDDSIDNKVLTRSDKNRGKSDNVPSEEVVKKMKNYWRQLLNA<br>KLITQRKFDNLTKAERGGLSELDKAGFIKRQLVETRQITKHVAQILDSRMNTKYD<br>ENDKLIREVKVITLKSKLVSDFRKDFQFYKVREINNYHHAHDAYLNAVVGTALIK<br>KYPKLESEFVYG | SEQ ID NO: 282 |
| CP1028 | EIGKATAKYFFYSNIMNFFKTEITLANGEIRKRPLIETNGETGEIVWDKGRDFAT<br>VRKVLSMPQVNIVKKTEVQTGGFSKESILPKRNSDKLIARKKDWDPKKYGGFDSP<br>TVAYSVLVVAKVEKGKSKKLKSVKELLGITIMERSSFEKNPIDFLEAKGYKEVKK<br>DLIIKLPKYSLFELENGRKRMLASAGELQKGNELALPSKYVNFLYLASHYEKLKG<br>SPEDNEQKQLFVEQHKHYLDEIIEQISEFSKRVILADANLDKVLSAYNKHRDKPI<br>REQAENIIHLFTLTNLGAPAAFKYFDTTIDRKRYTSTKEVLDATLIHQSITGLYE<br>TRIDLSQLGGDGGSGGSGGSGGSGGSGGSGG**M**DKKYSIGLAIGTNSVGWAVITDE<br>YKVPSKKFKVLGNTDRHSIKKNLIGALLFDSGETAEATRLKRTARRRYTRRKNRI<br>CYLQEIFSNEMAKVDDSFFHRLEESFLVEEDKKHERHPIFGNIVDEVAYHEKYPT<br>IYHLRKKLVDSTDKADLRLIYLALAHMIKFRGHFLIEGDLNPONSDVDKLFIQLV<br>QTYNQLFEENPINASGVDAKAILSARLSKSRRLENLIAQLPGEKKNGLFGNLIAL<br>SLGLTPNFKSNFDLAEDAKLQLSKDTYDDDLDNLLAQIGDQYADLFLAAKNLSDA<br>ILLSDILRVNTEITKAPLSASMIKRYDEHHQDLTLLKALVRQQLPEKYKEIFFDQ<br>SKNGYAGYIDGGASQEEFYKFIKPILEKMDGTEELLVKLNREDLLRKQRTFDNGS<br>IPHQIHLGELHAILRRQEDFYPFLKDNREKIEKILTFRIPYYVGPLARGNSRFAW<br>MTRKSEETITPWNFEEVVDKGASAQSFIERMTNFDKNLPNEKVLPKHSLLYEYFT<br>VYNELTKVKYVTEGMRKPAFLSGEQKKAIVDLLFKTNRKVTVKQLKEDYFKKIEC<br>FDSVEISGVEDRFNASLGTYHDLLKIIKDKDFLDNEENEDILEDIVLTLTLFEDR<br>EMIEERLKTYAHLFDDKVMKQLKRRRYTGWGRLSRKLINGIRDKQSGKTILDFLK<br>SDGFANRNFMQLIHDDSLTFKEDIQKAQVSGQGDSLHEHIANLAGSPAIKKGILQ<br>TVKVVDELVKVMGRHKPENIVIEMARENQTTQKGQKNSRERMKRIEEGIKELGSQ<br>ILKEHPVENTQLQNEKLYLYYLQNGRDMYVDQELDINRLSDYDVDHIVPQSFLKD<br>DSIDNKVLTRSDKNRGKSDNVPSEEVVKKMKNYWRQLLNAKLITQRKFDNLTKAE<br>RGGLSELDKAGFIKRQLVETRQITKHVAQILDSRMNTKYDENDKLIREVKVITLK<br>SKLVSDFRKDFQFYKVREINNYHHAHDAYLNAVVGTALIKKYPKLESEFVYGDYK<br>VYDVRKMIAKSEQ | SEQ ID NO: 283 |
| CP1041 | NIMNFFKTEITLANGEIRKRPLIETNGETGEIVWDKGRDFATVRKVLSMPQVNIV<br>KKTEVQTGGFSKESILPKRNSDKLIARKKDWDPKKYGGFDSPTVAYSVLVVAKVE<br>KGKSKKLKSVKELLGITIMERSSFEKNPIDFLEAKGYKEVKKDLIIKLPKYSLFE<br>LENGRKRMLASAGELQKGNELALPSKYVNFLYLASHYEKLKGSPEDNEQKQLFVE<br>QHKHYLDEIIEQISEFSKRVILADANLDKVLSAYNKHRDKPIREQAENIIHLFTL<br>TNLGAPAAFKYFDTTIDRKRYTSTKEVLDATLIHQSITGLYETRIDLSQLGGDGG<br>SGGSGGSGGSGGSGGSGGDKKYSIGLAIGTNSVGWAVITDEYKVPSKKFKVLGNT<br>DRHSIKKNLIGALLFDSGETAEATRLKRTARRRYTRRKNRICYLQEIFSNEMAKV<br>DDSFFHRLEESFLVEEDKKHERHPIFGNIVDEVAYHEKYPTIYHLRKKLVDSTDK<br>ADLRLIYLALAHMIKFRGHFLIEGDLNPONSDVDKLFIQLVQTYNQLFEENPINA<br>SGVDAKAILSARLSKSRRLENLIAQLPGEKKNGLFGNLIALSLGLTPNFKSNFDL<br>AEDAKLQLSKDTYDDDLDNLLAQIGDQYADLFLAAKNLSDAILLSDILRVNTEIT<br>KAPLSASMIKRYDEHHQDLTLLKALVRQQLPEKYKEIFFDQSKNGYAGYIDGGAS<br>QEEFYKFIKPILEKMDGTEELLVKLNREDLLRKQRTFDNGSIPHQIHLGELHAIL<br>RRQEDFYPFLKDNREKIEKILTFRIPYYVGPLARGNSRFAWMTRKSEETITPWNF<br>EEVVDKGASAQSFIERMTNFDKNLPNEKVLPKHSLLYEYFTVYNELTKVKYVTEG<br>MRKPAFLSGEQKKAIVDLLFKTNRKVTVKQLKEDYFKKIECFDSVEISGVEDRFN<br>ASLGTYHDLLKIIKDKDFLDNEENEDILEDIVLTLTLFEDREMIEERLKTYAHLF<br>DDKVMKQLKRRRYTGWGRLSRKLINGIRDKQSGKTILDFLKSDGFANRNFMQLIH<br>DDSLTFKEDIQKAQVSGQGDSLHEHIANLAGSPAIKKGILQTVKVVDELVKVMGR | SEQ ID NO: 284 |

-continued

| CPname | Sequence | SEQ ID NO: |
|---|---|---|
| | HKPENIVIEMARENQTTQKGQKNSRERMKRIEEGIKELGSQILKEHPVENTQLQN<br>EKLYLYYLQNGRDMYVDQELDINRLSDYDVDHIVPQSFLKDDSIDNKVLTRSDKN<br>RGKSDNVPSEEVVKKMKNYWRQLLNAKLITQRKFDNLTKAERGGLSELDKAGFIK<br>RQLVETRQITKHVAQILDSRMNTKYDENDKLIREVKVITLKSKLVSDFRKDFQFY<br>KVREINNYHHAHDAYLNAVVGTALIKKYPKLESEFVYGDYKVYDVRKMIAKSEQE<br>IGKATAKYFFYS | |
| CP1249 | PEDNEQKQLFVEQHKHYLDEIIEQISEFSKRVILADANLDKVLSAYNKHRDKPIR<br>EQAENIIHLFTLTNLGAPAAFKYFDTTIDRKRYTSTKEVLDATLIHQSITGLYET<br>RIDLSQLGGDGGSGGSGGSGGSGGSGGSGGMDKKYSIGLAIGTNSVGWAVITDEY<br>KVPSKKFKVLGNTDRHSIKKNLIGALLFDSGETAEATRLKRTARRRYTRRKNRIC<br>YLQEIFSNEMAKVDDSFFHRLEESFLVEEDKKHERHPIFGNIVDEVAYHEKYPTI<br>YHLRKKLVDSTDKADLRLIYLALAHMIKFRGHFLIEGDLNPONSDVDKLFIQLVQ<br>TYNQLFEENPINASGVDAKAILSARLSKSRRLENLIAQLPGEKKNGLFGNLIALS<br>LGLTPNFKSNFDLAEDAKLQLSKDTYDDDLDNLLAQIGDQYADLFLAAKNLSDAI<br>LLSDILRVNTEITKAPLSASMIKRYDEHHQDLTLLKALVRQQLPEKYKEIFFDQS<br>KNGYAGYIDGGASQEEFYKFIKPILEKMDGTEELLVKLNREDLLRKQRTFDNGSI<br>PHQIHLGELHAILRRQEDFYPFLKDNREKIEKILTFRIPYYVGPLARGNSRFAWM<br>TRKSEETITPWNFEEVVDKGASAQSFIERMTNFDKNLPNEKVLPKHSLLYEYFTV<br>YNELTKVKYVTEGMRKPAFLSGEQKKAIVDLLFKTNRKVTVKQLKEDYFKKIECF<br>DSVEISGVEDRFNASLGTYHDLLKIIKDKDFLDNEENEDILEDIVLTLTLFEDRE<br>MIEERLKTYAHLFDDKVMKQLKRRRYTGWGRLSRKLINGIRDKQSGKTILDFLKS<br>DGFANRNFMQLIHDDSLTFKEDIQKAQVSGQGDSLHEHIANLAGSPAIKKGILQT<br>VKVVDELVKVMGRHKPENIVIEMARENQTTQKGQKNSRERMKRIEEGIKELGSQI<br>LKEHPVENTQLQNEKLYLYYLQNGRDMYVDQELDINRLSDYDVDHIVPQSFLKDD<br>SIDNKVLTRSDKNRGKSDNVPSEEVVKKMKNYWRQLLNAKLITQRKFDNLTKAER<br>GGLSELDKAGFIKRQLVETRQITKHVAQILDSRMNTKYDENDKLIREVKVITLKS<br>KLVSDFRKDFQFYKVREINNYHHAHDAYLNAVVGTALIKKYPKLESEFVYGDYKV<br>YDVRKMIAKSEQEIGKATAKYFFYSNIMNFFKTEITLANGEIRKRPLIETNGETG<br>EIVWDKGRDFATVRKVLSMPQVNIVKKTEVQTGGFSKESILPKRNSDKLIARKKD<br>WDPKKYGGFDSPTVAYSVLVVAKVEKGKSKKLKSVKELLGITIMERSSFEKNPID<br>FLEAKGYKEVKKDLIIKLPKYSLFELENGRKRMLASAGELQKGNELALPSKYVNF<br>LYLASHYEKLKGS | SEQ ID NO:<br>285 |
| CP1300 | KPIREQAENIIHLFTLTNLGAPAAFKYFDTTIDRKRYTSTKEVLDATLIHQSITG<br>LYETRIDLSQLGGDGGSGGSGGSGGSGGSGGSGGDKKYSIGLAIGTNSVGWAVIT<br>DEYKVPSKKFKVLGNTDRHSIKKNLIGALLFDSGETAEATRLKRTARRRYTRRKN<br>RICYLQEIFSNEMAKVDDSFFHRLEESFLVEEDKKHERHPIFGNIVDEVAYHEKY<br>PTIYHLRKKLVDSTDKADLRLIYLALAHMIKFRGHFLIEGDLNPONSDVDKLFIQ<br>LVQTYNQLFEENPINASGVDAKAILSARLSKSRRLENLIAQLPGEKKNGLFGNLI<br>ALSLGLTPNFKSNFDLAEDAKLQLSKDTYDDDLDNLLAQIGDQYADLFLAAKNLS<br>DAILLSDILRVNTEITKAPLSASMIKRYDEHHQDLTLLKALVRQQLPEKYKEIFF<br>DQSKNGYAGYIDGGASQEEFYKFIKPILEKMDGTEELLVKLNREDLLRKQRTFDN<br>GSIPHQIHLGELHAILRRQEDFYPFLKDNREKIEKILTFRIPYYVGPLARGNSRF<br>AWMTRKSEETITPWNFEEVVDKGASAQSFIERMTNFDKNLPNEKVLPKHSLLYEY<br>FTVYNELTKVKYVTEGMRKPAFLSGEQKKAIVDLLFKTNRKVTVKQLKEDYFKKI<br>ECFDSVEISGVEDRFNASLGTYHDLLKIIKDKDFLDNEENEDILEDIVLTLTLFE<br>DREMIEERLKTYAHLFDDKVMKQLKRRRYTGWGRLSRKLINGIRDKQSGKTILDF<br>LKSDGFANRNFMQLIHDDSLTFKEDIQKAQVSGQGDSLHEHIANLAGSPAIKKGI<br>LQTVKVVDELVKVMGRHKPENIVIEMARENQTTQKGQKNSRERMKRIEEGIKELG<br>SQILKEHPVENTQLQNEKLYLYYLQNGRDMYVDQELDINRLSDYDVDHIVPQSFL<br>KDDSIDNKVLTRSDKNRGKSDNVPSEEVVKKMKNYWRQLLNAKLITQRKFDNLTK<br>AERGGLSELDKAGFIKRQLVETRQITKHVAQILDSRMNTKYDENDKLIREVKVIT<br>LKSKLVSDFRKDFQFYKVREINNYHHAHDAYLNAVVGTALIKKYPKLESEFVYGD<br>YKVYDVRKMIAKSEQEIGKATAKYFFYSNIMNFFKTEITLANGEIRKRPLIETNG<br>ETGEIVWDKGRDFATVRKVLSMPQVNIVKKTEVQTGGFSKESILPKRNSDKLIAR<br>KKDWDPKKYGGFDSPTVAYSVLVVAKVEKGKSKKLKSVKELLGITIMERSSFEKN<br>PIDFLEAKGYKEVKKDLIIKLPKYSLFELENGRKRMLASAGELQKGNELALPSKY<br>VNFLYLASHYEKLKGSPEDNEQKQLFVEQHKHYLDEIIEQISEFSKRVILADANL<br>DKVLSAYNKHRD | SEQ ID NO:<br>286 |

The Cas9 circular permutants that may be useful in the base editing constructs described herein. Exemplary C-terminal fragments of Cas9, based on the Cas9 of SEQ ID NO: 1, which may be rearranged to an N-terminus of Cas9, are provided below. It should be appreciated that such C-terminal fragments of Cas9 are exemplary and are not meant to be limiting. These exemplary CP-Cas9 fragments have the following sequences:

| CP name | Sequence | SEQ ID NO: |
|---|---|---|
| CP1012 C-terminal fragment | DYKVYDVRKMIAKSEQEIGKATAKYFFYSNIMNFFKTEITLANGEIRKRPLIETN<br>GETGEIVWDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIMERSSFEK<br>NPIDFLEAKGYKEVKKDLIIKLPKYSLFELENGRKRMLASAGELQKGNELALPSK<br>YVNFLYLASHYEKLKGSPEDNEQKQLFVEQHKHYLDEIIEQISEFSKRVILADAN | SEQ ID NO:<br>287 |

-continued

| CP name | Sequence | SEQ ID NO: |
|---|---|---|
| | LDKVLSAYNKHRDKPIREQAENIIHLFTLTNLGAPAAFKYFDTTIDRKRYTSTKE VLDATLIHQSITGLYETRIDLSQLGGD | |
| CP1028 C-terminal fragment | EIGKATAKYFFYSNIMNFFKTEITLANGEIRKRPLIETNGETGEIVWDKGRDFAT VRKVLSMPQVNIVKKTEVQTGGFSKESILPKRNSDKLIARKKDWDPKKYGGFDSP TVAYSVLVVAKVEKGKSKKLKSVKELLGITIMERSSFEKNPIDFLEAKGYKEVKK DLIIKLPKYSLFELENGRKRMLASAGELQKGNELALPSKYVNFLYLASHYEKLKG SPEDNEQKQLFVEQHKHYLDEIIEQISEFSKRVILADANLDKVLSAYNKHRDKPI REQAENIIHLFTLTNLGAPAAFKYFDTTIDRKRYTSTKEVLDATLIHQSITGLYE TRIDLSQLGGD | SEQ ID NO: 288 |
| CP1041 C-terminal fragment | NIMNFFKTEITLANGEIRKRPLIETNGETGEIVWDKGRDFATVRKVLSMPQVNIV KKTEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSLFE LENGRKRMLASAGELQKGNELALPSKYVNFLYLASHYEKLKGSPEDNEQKQLFVE QHKHYLDEIIEQISEFSKRVILADANLDKVLSAYNKHRDKPIREQAENIIHLFTL TNLGAPAAFKYFDTTIDRKRYTSTKEVLDATLIHQSITGLYETRIDLSQLGGD | SEQ ID NO: 289 |
| CP1249 C-terminal fragment | PEDNEQKQLFVEQHKHYLDEIIEQISEFSKRVILADANLDKVLSAYNKHRDKPIR EQAENIIHLFTLTNLGAPAAFKYFDTTIDRKRYTSTKEVLDATLIHQSITGLYET RIDLSQLGGD | SEQ ID NO: 290 |
| CP1300 C-terminal fragment | KPIREQAENIIHLFTLTNLGAPAAFKYFDTTIDRKRYTSTKEVLDATLIHQSITG LYETRIDLSQLGGD | SEQ ID NO: 291 |

An exemplary alignment of four Cas9 sequences is provided below. The Cas9 sequences in the alignment are: Sequence 1 (S1): SEQ ID NO: 1|WP_010922251| gi 499224711|type II CRISPR RNA-guided endonuclease Cas9 [*Streptococcus pyogenes*]; Sequence 2 (S2): SEQ ID NO: 27|WP_039695303|gi 746743737|type II CRISPR RNA-guided endonuclease Cas9 [*Streptococcus gallolyticus*]; Sequence 3 (S3): SEQ ID NO: 28|WP_045635197|gi 782887988|type II CRISPR RNA-guided endonuclease Cas9 [*Streptococcus mitis*]; Sequence 4 (S4): SEQ ID NO: 29|5AXW_A|gi 924443546|*Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

| | | | |
|---|---|---|---|
| S1 | 1 | --MDKK-**YSIGLD*IGTNSVGWAVITDEYKVESKKEKVLGNTDRESIKKNLI--GALLEDSG--ET**AKATRLKRTARRRYT | 73 |
| S2 | 1 | --MTKKN**YSIGLD*IGTNSVGWAVITDDYKVPAKKMKVIGNTDKEYIKKNLL--GALLEDSG--ET**AKATRLKRTARRRYT | 74 |
| S3 | 1 | --M-KKG**YSIGLD*IGTNSVGFAVITDDYKVESKEMEVLGNTDERFIKKNLI--GALLFDEG--TT**AKARRLKRTARRRYT | 73 |
| S4 | 1 | GSHMKRN**YILGLD*IGITSVGYGII--DYET-----------------RDVIDAGVRIFKEANVEN**NEGRRSKRGARRLKR | 61 |
| S1 | 74 | RRKNRICYLQEIFSNEMAKVDDSFFHRLEESFLVEEDKKHERHPIFGNIVDEVAYHEKYPTIYHLRKKLVDSTDKADLRL | 153 |
| S2 | 75 | RRKNRLRYLQEIFANEIAKVDESFFQRLDESFLTDDDKTEDSHPIFGNKAEEDAYHQKFPTIYHLRKHLADSSEKADLRL | 154 |
| S3 | 74 | RRKNRLRYLQEIFSEEMSKVDSSFFHRLDDSFLIPEDKRESKYPIFATLTEEKEYHKQFPTIYHLRKQLADSKEKTDLRL | 153 |
| S4 | 62 | RRRHRIQRVKKLL--------------FDYNLLTD--------------------HSELSGINPYEARVKGLSQKLSEEE | 107 |
| S1 | 154 | IYLALAHMIKERGHFLIEGDLNPDNSDVDKLFIQLVQTYNQLFEENPINASGVDAKAILSARLSKSRRLENLIAQLPGEK | 233 |
| S2 | 155 | VYLALAHMIKFRGHFLIEGELNAENTDVQKIFADFVGVYNRTFDDSHLSEITVDVASILTEKISKSRRLENLIKYYPTEK | 234 |
| S3 | 154 | IYLALAHMIKYRGHFLYEEAFDIKNNDIQKIFNEFISIYDNTFEGSSLSGQNAQVEAIFTDKISKSAKRERVLKLEPDEK | 233 |
| S4 | 108 | FSAALLHLAKRRG----------------------VHNVNEVEEDT---------------------------------- | 131 |
| S1 | 234 | KNGLFGNLIALSLGLTPNEKSNFDLAEDAKLQLSKDTYDDDLDNLLAQIGDQYADLFLAAKNLSDAILLSDILRVNTEIT | 313 |
| S2 | 235 | KNTLFGNLIALALGLQPNEKTNFKLSEDAKLQFSKDTYEEDLEELLGKIGDDYADLFTSAKNLYDAILLSGILTVDDNST | 314 |
| S3 | 234 | STGLFSEFLKLIVGNQADFKKHFDLEDKAPLQFSKDTYDEDLENLLGQIGDDFTDLFVSAKKLYDAILLSGILTVTDPST | 313 |
| S4 | 132 | -----GNELS------------------TKEQISRN-------------------------------------------- | 144 |
| S1 | 314 | KAPLSASMIKRYDEHHQDLTLLKALVRQQLPEKYKEIFFDQSKNGYAGYIDGGASQEEFYKFIKPILEKM--DGTEELLV | 391 |
| S2 | 315 | KAPLSASMIKRYVEHHEDLEKLKEFIKANKSELYHDIFKDKNKNGYAGYIENGVKQDEFYKYLKNILSKIKIDGSDYFLD | 394 |
| S3 | 314 | KAPLSASMIERYENHQNDLAALKQFIKNNLPEKYDEVFSDQSKDGYAGYIDGKTTQETFYKYIKNLLSKF--EGTDYFLD | 391 |

-continued

```
S4   145  ----SKALEEKYVAELQ---------------------------------------------LERLKKDG------   165
S1   392  KLNREDLLRKQRTFDNGSIPHQIHLGELHAILRRQEDFYPFLKDNREKIEKILTFRIPYYVGPLARGNSRFAWMTRKSEE   471
S2   395  KIEREDFLRKQRTFDNGSIPHQIHLQEMHAILRRQGDYYPFLKEKQDRIEKILTFRIPYYVGPLVRKDSRFAWAEYRSDE   474
S3   392  KIEREDFLRKQRTFDNGSIPHQIHLQEMNAILRRQGEYYPFLKDNKEKIEKILTFRIPYYVGPLARGNRDFAWLTRNSDE   471
S4   166  --EVRGSINRFKTSD--------YVKEAKQLLKVQKAYHQLDQSFIDTYIDLLETRRTYYEGP--GEGSPFGW------K   227
S1   472  TITPWNFEEVVDKGASAQSFIERMTNFDKNLPNEKVLPKHSLLYEYFTVYNELTKVKYVTEGMRKPAFLSGEQKKAIVDL   551
S2   475  KITPWNFDKVIDKEKSAEKFITRMTLNDLYLPEEKVLPKHSHVYETYAVYNELTKIKYVNEQGKE-SFFDSNMKQEIFDH   553
S3   472  AIRPWNFEEIVDKASSAEDFINKMTNYDLYLPEEKVLPKHSLLYETFAVYNELTKVKFIAEGLRDYQFLDSGQKKQIVNQ   551
S4   228  DIKEW---------------YEMLMGHCTYFPEELRSVKYAYNADLYNALNDLNNLVITRDENEK---LEYYEKFQIIEN   289
S1   552  LFKTNRKVTVKQLKEDYFKKIECFDSVEISGVEDR---FNASLGTYHDLLKIIKDKDFLDNEENEDILEDIVLTLTLFED   628
S2   554  VFKENRKVTKEKLLNYLNKEFFEYRIKDLIGLDKENKSFNASLGTYHDLKKIL-DKAFLDDKVNEEVIEDIIKTLTLFED   632
S3   552  LEKENRKVTEKDIIHYLHN-VDGYDGIELKGIEKQ---FNASLSTYHDLLKIIKDKEEMDDAKNEAILENIVHTLTIFED   627
S4   290  VFKQKKKPTLKQIAKEILVNEEDIKGYRVTSTGKPEF---TNLKVYHDIKDITARKEII---ENAELLDQIAKILTIYQS   363
S1   629  REMIEERLKTYAHLFDDKVMKQLKR-RRYTGWGRLSRKLINGIRDKQSGKTILDFLKSDGFANRNFMQLIHDDSLTFKED   707
S2   633  KDMIHERLQKYSDIFTANQLKKLER-RHYTGWGRLSYKLINGIRNKENNKTILDYLIDDGSANRNFMQLINDDTLPFKQI   711
S3   628  REMIKQRLAQYDSLFDEKVIKALTR-RHYTGWGKLSAKLINGICDKQTGNTILDYLIDDGKINRNFMQLINDDGLSFKEI   706
S4   364  SEDIQEELTNLNSELTQEEIEQISNLKGYTGTHNLSLKAINLILDE-----LWHTNDNQTAIENRLKLVP----------   428
S1   708  IQKAQVSGQGDSLHEHIANLAGSPAIKKGILQTVKVVDELVKVMGRHKPENIVIEMARENQTT------QKGQKNSRERM   781
S2   712  IQKSQVVGDVDDIEAVVHDLPGSPAIKKGILQSVKIVDELVKVMG-GNPDNIVIEMARENQTT------NRGRSQSQQRL   784
S3   707  IQKAQVIGKTDDVKQVVQELSGSPAIKKGILQSIKIVDELVKVMG-HAPESIVIEMARENQTT------ARGKKNSQQRY   779
S4   429  -KKVDLSQQKEIPTTLVDDFILSPVVKRSFIQSIKVINAIIKKYG--LPNDIIIELAREKNSKDAQKMINEMQKRNRQTN   505
S1   782  KRIEEGIKELGSQIL-------KEHPVENTQLQNEKLYLYYLQNGRDMYVDQELDINRLSD----YDVDH*IVPQSFLKDD   850
S2   785  KKLQNSLKELGSNILNEEKPSYIEDKVENSHLQNDQLFLYYIQNGKDMYTGDELDIDHLSD----YDIDH*IIPQAFIKDD   860
S3   780  KRIEDSLKILASGL---DSNILKENPTDNNQLQNDRLFLYYLQNGKDMYTGEALDINQLSS----YDIDH*IIPQAFIKDD   852
S4   506  ERIEEIIRTTGK---------------ENAKYLIEKIKLHDMQEGKCLYSLEAIPLEDLLNNPFNYEVDH*IIPRSVSFDN   570
S1   851  SIDNKVLTRSDKNRGKSDNVPSEEVVKKMKNYWRQLLNAKLITQRKFDN-LTKAERGGL-SELD------KAGFIKRQLV   922
S2   861  SIDNKVLTSSAKNRGKSDDVPSLDIVRARKAEWVRLYKSGLISKRKFDN-LTKAERGGL-TEAD------KAGFIKRQLV   932
S3   853  SLDNKVLTSSKDNRGKSDNVPSIEVVQKRKAFWQQLLDSKLISERKFNN-LTKAERGGL-DERD------KAGFIKRQLV   924
S4   571  SFNNKVLVKQEEASKKGNRTPFQYLSSSDSKISYETFKKHILNLAKGKGRISKTKKEYLLEERDINRFSVQKDFINRNLV   650
S1   923  ETRQITKHVAQILDSRMNTKYDENDKLIREVKVITLKSKLVSDFRKDFQFYKVREINNYHHAHDAYLNAVVGTALIKKYP  1002
S2   933  ETRQITKHVAQILDARFNTEHDENDKVIRVVKVITLKSNLVSQFRKDFEFYKVREINDYHHAHDAYLNAVVGTALIKKYP  1012
S3   925  ETRQITKHVAQILDARYNTEVNEKDKKNRTVKIITLKSNLVSNFRKEFRLYKVREINDYHHAHDAYLNAVVAKAILKKYP  1004
S4   651  DTRYATRGLMNLLRSYFRVN-------NLDVKVKSINGGFTSFLRRKWKFKKERNKGYKHHAEDALIIA-----------   712
S1  1003  KLESEFVYGDYKVYDVRMIAKSEQ--EIGKATAKYFFYSNIMNFFKTEITLANGEIRKRPLIETNGETGEIVWDKG---  1077
S2  1013  KLASEFVYGEYKKYDIRKFITNSSD-----KATAKYFFYSNLMNFFKTKVKADGTVFERPIIETNAD-GEIAWNKQ---  1083
```

-continued

```
S3   1005 KLEPEFVYGEYQKYDLKRYISRSKDPKEVEKATEKYFFYSNLLNFFKEEVHYADGTIVKRENIEYSKDTGEIAWNKE---  1081

S4    713 --NADFIFKEWKKLDKAKKVMENQM-------------------------FEEKQAESMPEIETEQEYKEIFITPHQIK   764

S1   1078 -----RDFATVRKVLSMPQVNIVKKTEVQTGGFSKESILPKRNSDKLIARKKD---WDPKKYGGFDSPTVAYSVLVVAKV  1149

S2   1084 -----IDFEKVRKVLSYPQVNIVKKVETQTGGFSKESILPKGDSDKLIPRKTKKVYWDTKKYGGFDSPTVAYSVFVVADV  1158

S3   1082 -----KDFAIIKKVLSLPQVNIVKKREVQTGGFSKESILPKGNSDKLIPRKTKDILLDTTKYGGFDSPVIAYSILLIADI  1156

S4    765 HIKDFKDYKYSHRVDKKPNRELINDTLYSTRKDDKGNTLIVNNLNGLYDKDNDKL----KKLIN-KSP----EKLLMYHH   835

S1   1150 EKGKSKKLKSVKELLGITIMERSSFEKNPI-DFLEAKG------YKEVKKDLIIKLPKYSLFELENGRKRMLASAGELQKG  1223

S2   1159 EKGKAKKLKTVKELVGISIMERSFFEENPV-EFLENKG------YHNIREDKLIKLPKYSLFEFEGGRRRLLASASELQKG  1232

S3   1157 EKGKAKKLKTVKTLVGITIMEKAAFEENPI-TFLENKG------YHNVRKENILCLPKYSLFELENGRRRLLASAKELQKG  1230

S4    836 DPQTYQKLK---------LIMEQYGDEKNPLYKYYEETGNYLTKYSKKDNGPVIKKIKYYGNKLNAHLDITDDYPNSRNKV   907

S1   1224 NELALPSKYVNFLYLASHYEKLKGSPEDNEQKQLFVEQHKHYLDEITEQISEFSKRVILADANLDKVLSAYNKH------  1297

S2   1233 NEMVLPGYLVELLYHAHRADNF-----NSTEYLNYVSEHKKEFEKVLSCVEDFANLYVDVEKNLSKIRAVADSM------  1301

S3   1231 NEIVLPVYLTTLLYHSKNVHKL-----DEPGHLEYIQKHRNEFKDLLNLVSEFSQKYVLADANLEKIKSLYADN------  1299

S4    908 VKLSLKPYRFD-VYLDNGVYKFV-----TVKNLDVIK--KENYYEVNSKAYEEAKKLKKISNQAEFIASFYNNDLIKING   979

S1   1298 RDKPIREQAENITHLFTLTNLGAPAAFKYFDTTIDRKRYTSTKEVLDATLIHQSIT--------GLYETRI----DLSQL  1365

S2   1302 DNFSIEEISNSFINLLTLTALGAPADFNFLGEKIPRKRYTSTKECLNATLIHQSIT--------GLYETRI----DLSKL  1369

S3   1300 EQADIEILANSFINLLTFTALGAPAAFKFFGKDIDRKRYTTVSEILNATLIHQSIT--------GLYETWI----DLSKL  1367

S4    980 ELYRVIGVNNDLLNRIEVNMIDITYR-EYLENMNDKRPPRIIKTIASKT---QSIKKYSTDILGNLYEVKSKKHPQIIKK  1055

S1   1366 GGD                                                                               1368

S2   1370 GEE                                                                               1372

S3   1368 GED                                                                               1370

S4   1056 G--                                                                               1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 1 and 27-29 (e.g., 51, S2, S3, and S4, respectively) are mutated as described herein. The residues D10 and H840 in Cas9 of SEQ ID NO: 1 that correspond to the residues identified in SEQ ID NOs: 1 and 27-29 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 1 herein, e.g., mutations of residues 10, and 840 in SEQ ID NO: 1, are referred to herein as "homologous" or "corresponding" mutations. For example, the mutations corresponding to the D10A mutation in SEQ ID NO: 1 (51) for the four aligned sequences above are D11A for S2, D10A for S3, and D13A for S4; the corresponding mutations for H840A in SEQ ID NO: 1 (S1) are H850A for S2, H842A for S3, and H560A for S4.

A total of 250 Cas9 sequences (SEQ ID NOs: 1 and 27-275) from different species are provided. Amino acid residues corresponding to residues 10 and 840 of SEQ ID NO: 1 may be identified in the same manner as outlined above. All of these Cas9 sequences may be used in accordance with the present disclosure.

WP_010922251.1 type II CRISPR RNA-guided endonuclease Cas9 [*Streptococcus pyogenes*] SEQ ID NO: 1

WP_039695303.1 type II CRISPR RNA-guided endonuclease Cas9 [*Streptococcus gallolyticus*] SEQ ID NO: 27

WP_045635197.1 type II CRISPR RNA-guided endonuclease Cas9 [*Streptococcus mitis*] SEQ ID NO: 28

5AXW_A Cas9, Chain A, Crystal Structure [*Staphylococcus aureus*] SEQ ID NO: 29

WP_009880683.1 type II CRISPR RNA-guided endonuclease Cas9 [*Streptococcus pyogenes*] SEQ ID NO: 30

WP_010922251.1 type II CRISPR RNA-guided endonuclease Cas9 [*Streptococcus pyogenes*] SEQ ID NO: 31

WP_011054416.1 type II CRISPR RNA-guided endonuclease Cas9 [*Streptococcus pyogenes*] SEQ ID NO: 32

WP_011284745.1 type II CRISPR RNA-guided endonuclease Cas9 [*Streptococcus pyogenes*] SEQ ID NO: 33
WP_011285506.1 type II CRISPR RNA-guided endonuclease Cas9 [*Streptococcus pyogenes*] SEQ ID NO: 34
WP_011527619.1 type II CRISPR RNA-guided endonuclease Cas9 [*Streptococcus pyogenes*] SEQ ID NO: 35
WP_012560673.1 type II CRISPR RNA-guided endonuclease Cas9 [*Streptococcus pyogenes*] SEQ ID NO: 36
WP_014407541.1 type II CRISPR RNA-guided endonuclease Cas9 [*Streptococcus pyogenes*] SEQ ID NO: 37
WP_020905136.1 type II CRISPR RNA-guided endonuclease Cas9 [*Streptococcus pyogenes*] SEQ ID NO: 38
WP_023080005.1 type II CRISPR RNA-guided endonuclease Cas9 [*Streptococcus pyogenes*] SEQ ID NO: 39
WP_023610282.1 type II CRISPR RNA-guided endonuclease Cas9 [*Streptococcus pyogenes*] SEQ ID NO: 40
WP_030125963.1 type II CRISPR RNA-guided endonuclease Cas9 [*Streptococcus pyogenes*] SEQ ID NO: 41
WP_030126706.1 type II CRISPR RNA-guided endonuclease Cas9 [*Streptococcus pyogenes*] SEQ ID NO: 42
WP_031488318.1 type II CRISPR RNA-guided endonuclease Cas9 [*Streptococcus pyogenes*] SEQ ID NO: 43
WP_032460140.1 type II CRISPR RNA-guided endonuclease Cas9 [*Streptococcus pyogenes*] SEQ ID NO: 44
WP_032461047.1 type II CRISPR RNA-guided endonuclease Cas9 [*Streptococcus pyogenes*] SEQ ID NO: 45
WP_032462016.1 type II CRISPR RNA-guided endonuclease Cas9 [*Streptococcus pyogenes*] SEQ ID NO: 46
WP_032462936.1 type II CRISPR RNA-guided endonuclease Cas9 [*Streptococcus pyogenes*] SEQ ID NO: 47
WP_032464890.1 type II CRISPR RNA-guided endonuclease Cas9 [*Streptococcus pyogenes*] SEQ ID NO: 48
WP_033888930.1 type II CRISPR RNA-guided endonuclease Cas9 [*Streptococcus pyogenes*] SEQ ID NO: 49
WP_038431314.1 type II CRISPR RNA-guided endonuclease Cas9 [*Streptococcus pyogenes*] SEQ ID NO: 50
WP_038432938.1 type II CRISPR RNA-guided endonuclease Cas9 [*Streptococcus pyogenes*] SEQ ID NO: 51
WP_038434062.1 type II CRISPR RNA-guided endonuclease Cas9 [*Streptococcus pyogenes*] SEQ ID NO: 52
BAQ51233.1 CRISPR-associated protein, Csn1 family [*Streptococcus pyogenes*] SEQ ID NO: 53
KGE60162.1 hypothetical protein MGAS2111_0903 [*Streptococcus pyogenes* MGAS2111] SEQ ID NO: 54
KGE60856.1 CRISPR-associated endonuclease protein [*Streptococcus pyogenes* SS1447] SEQ ID NO: 55
WP_002989955.1 MULTISPECIES: type II CRISPR RNA-guided endonuclease Cas9 [*Streptococcus*] SEQ ID NO: 56
WP_003030002.1 MULTISPECIES: type II CRISPR RNA-guided endonuclease Cas9 [*Streptococcus*] SEQ ID NO: 57
WP_003065552.1 MULTISPECIES: type II CRISPR RNA-guided endonuclease Cas9 [*Streptococcus*] SEQ ID NO: 58
WP_001040076.1 type II CRISPR RNA-guided endonuclease Cas9 [*Streptococcus agalactiae*] SEQ ID NO: 59
WP_001040078.1 type II CRISPR RNA-guided endonuclease Cas9 [*Streptococcus agalactiae*] SEQ ID NO: 60
WP_001040080.1 type II CRISPR RNA-guided endonuclease Cas9 [*Streptococcus agalactiae*] SEQ ID NO: 61
WP_001040081.1 type II CRISPR RNA-guided endonuclease Cas9 [*Streptococcus agalactiae*] SEQ ID NO: 62
WP_001040083.1 type II CRISPR RNA-guided endonuclease Cas9 [*Streptococcus agalactiae*] SEQ ID NO: 63
WP_001040085.1 type II CRISPR RNA-guided endonuclease Cas9 [*Streptococcus agalactiae*] SEQ ID NO: 64
WP_001040087.1 type II CRISPR RNA-guided endonuclease Cas9 [*Streptococcus agalactiae*] SEQ ID NO: 65
WP_001040088.1 type II CRISPR RNA-guided endonuclease Cas9 [*Streptococcus agalactiae*] SEQ ID NO: 66
WP_001040089.1 type II CRISPR RNA-guided endonuclease Cas9 [*Streptococcus agalactiae*] SEQ ID NO: 67
WP_001040090.1 type II CRISPR RNA-guided endonuclease Cas9 [*Streptococcus agalactiae*] SEQ ID NO: 68
WP_001040091.1 type II CRISPR RNA-guided endonuclease Cas9 [*Streptococcus agalactiae*] SEQ ID NO: 69
WP_001040092.1 type II CRISPR RNA-guided endonuclease Cas9 [*Streptococcus agalactiae*] SEQ ID NO: 70
WP_001040094.1 type II CRISPR RNA-guided endonuclease Cas9 [*Streptococcus agalactiae*] SEQ ID NO: 71
WP_001040095.1 type II CRISPR RNA-guided endonuclease Cas9 [*Streptococcus agalactiae*] SEQ ID NO: 72
WP_001040096.1 type II CRISPR RNA-guided endonuclease Cas9 [*Streptococcus agalactiae*] SEQ ID NO: 73
WP_001040097.1 type II CRISPR RNA-guided endonuclease Cas9 [*Streptococcus agalactiae*] SEQ ID NO: 74
WP_001040098.1 type II CRISPR RNA-guided endonuclease Cas9 [*Streptococcus agalactiae*] SEQ ID NO: 75
WP_001040099.1 type II CRISPR RNA-guided endonuclease Cas9 [*Streptococcus agalactiae*] SEQ ID NO: 76
WP_001040100.1 type II CRISPR RNA-guided endonuclease Cas9 [*Streptococcus agalactiae*] SEQ ID NO: 77
WP_001040104.1 type II CRISPR RNA-guided endonuclease Cas9 [*Streptococcus agalactiae*] SEQ ID NO: 78
WP_001040105.1 type II CRISPR RNA-guided endonuclease Cas9 [*Streptococcus agalactiae*] SEQ ID NO: 79
WP_001040106.1 type II CRISPR RNA-guided endonuclease Cas9 [*Streptococcus agalactiae*] SEQ ID NO: 80
WP_001040107.1 type II CRISPR RNA-guided endonuclease Cas9 [*Streptococcus agalactiae*] SEQ ID NO: 81
WP_001040108.1 type II CRISPR RNA-guided endonuclease Cas9 [*Streptococcus agalactiae*] SEQ ID NO: 82
WP_001040109.1 type II CRISPR RNA-guided endonuclease Cas9 [*Streptococcus agalactiae*] SEQ ID NO: 83
WP_001040110.1 type II CRISPR RNA-guided endonuclease Cas9 [*Streptococcus agalactiae*] SEQ ID NO: 84
WP_015058523.1 type II CRISPR RNA-guided endonuclease Cas9 [*Streptococcus agalactiae*] SEQ ID NO: 85
WP_017643650.1 type II CRISPR RNA-guided endonuclease Cas9 [*Streptococcus agalactiae*] SEQ ID NO: 86
WP_017647151.1 type II CRISPR RNA-guided endonuclease Cas9 [*Streptococcus agalactiae*] SEQ ID NO: 87
WP_017648376.1 type II CRISPR RNA-guided endonuclease Cas9 [*Streptococcus agalactiae*] SEQ ID NO: 88
WP_017649527.1 type II CRISPR RNA-guided endonuclease Cas9 [*Streptococcus agalactiae*] SEQ ID NO: 89
WP_017771611.1 type II CRISPR RNA-guided endonuclease Cas9 [*Streptococcus agalactiae*] SEQ ID NO: 90
WP_017771984.1 type II CRISPR RNA-guided endonuclease Cas9 [*Streptococcus agalactiae*] SEQ ID NO: 91
CFQ25032.1 CRISPR-associated protein [*Streptococcus agalactiae*] SEQ ID NO: 92
CFV16040.1 CRISPR-associated protein [*Streptococcus agalactiae*] SEQ ID NO: 93
KLJ37842.1 CRISPR-associated protein Csn1 [*Streptococcus agalactiae*] SEQ ID NO: 94
KLJ72361.1 CRISPR-associated protein Csn1 [*Streptococcus agalactiae*] SEQ ID NO: 95
KLL20707.1 CRISPR-associated protein Csn1 [*Streptococcus agalactiae*] SEQ ID NO: 96
KLL42645.1 CRISPR-associated protein Csn1 [*Streptococcus agalactiae*] SEQ ID NO: 97

WP_047207273.1 type II CRISPR RNA-guided endonuclease Cas9 [*Streptococcus agalactiae*] SEQ ID NO: 98
WP_047209694.1 type II CRISPR RNA-guided endonuclease Cas9 [*Streptococcus agalactiae*] SEQ ID NO: 99
WP_050198062.1 type II CRISPR RNA-guided endonuclease Cas9 [*Streptococcus agalactiae*] SEQ ID NO: 100
WP_050201642.1 type II CRISPR RNA-guided endonuclease Cas9 [*Streptococcus agalactiae*] SEQ ID NO: 101
WP_050204027.1 type II CRISPR RNA-guided endonuclease Cas9 [*Streptococcus agalactiae*] SEQ ID NO: 102
WP_050881965.1 type II CRISPR RNA-guided endonuclease Cas9 [*Streptococcus agalactiae*] SEQ ID NO: 103
WP_050886065.1 type II CRISPR RNA-guided endonuclease Cas9 [*Streptococcus agalactiae*] SEQ ID NO: 104
AHN30376.1 CRISPR-associated protein Csn1 [*Streptococcus agalactiae* 138P] SEQ ID NO: 105
EAO78426.1 reticulocyte binding protein [*Streptococcus agalactiae* H36B] SEQ ID NO: 106
CCW42055.1 CRISPR-associated protein, SAG0894 family [*Streptococcus agalactiae* ILRI112] SEQ ID NO:107
WP_003041502.1 type II CRISPR RNA-guided endonuclease Cas9 [*Streptococcus anginosus*] SEQ ID NO: 108
WP_037593752.1 type II CRISPR RNA-guided endonuclease Cas9 [*Streptococcus anginosus*] SEQ ID NO: 109
WP_049516684.1 CRISPR-associated protein Csn1 [*Streptococcus anginosus*] SEQ ID NO: 110
GAD46167.1 hypothetical protein ANG6_0662 [*Streptococcus anginosus* T5] SEQ ID NO: 111
WP_018363470.1 type II CRISPR RNA-guided endonuclease Cas9 [*Streptococcus caballi*] SEQ ID NO: 112
WP_003043819.1 type II CRISPR RNA-guided endonuclease Cas9 [*Streptococcus* can's] SEQ ID NO: 113
WP_006269658.1 type II CRISPR RNA-guided endonuclease Cas9 [*Streptococcus constellatus*] SEQ ID NO: 114
WP_048800889.1 type II CRISPR RNA-guided endonuclease Cas9 [*Streptococcus constellatus*] SEQ ID NO: 115
WP_012767106.1 type II CRISPR RNA-guided endonuclease Cas9 [*Streptococcus dysgalactiae*] SEQ ID NO: 116
WP_014612333.1 type II CRISPR RNA-guided endonuclease Cas9 [*Streptococcus dysgalactiae*] SEQ ID NO: 117
WP_015017095.1 type II CRISPR RNA-guided endonuclease Cas9 [*Streptococcus dysgalactiae*] SEQ ID NO: 118
WP_015057649.1 type II CRISPR RNA-guided endonuclease Cas9 [*Streptococcus dysgalactiae*] SEQ ID NO: 119
WP_048327215.1 type II CRISPR RNA-guided endonuclease Cas9 [*Streptococcus dysgalactiae*] SEQ ID NO: 143
WP_049519324.1 CRISPR-associated protein Csn1 [*Streptococcus dysgalactiae*] SEQ ID NO: 144
WP_012515931.1 type II CRISPR RNA-guided endonuclease Cas9 [*Streptococcus equi*] SEQ ID NO: 145
WP_021320964.1 type II CRISPR RNA-guided endonuclease Cas9 [*Streptococcus equi*] SEQ ID NO: 146
WP_037581760.1 type II CRISPR RNA-guided endonuclease Cas9 [*Streptococcus equi*] SEQ ID NO: 147
WP_004232481.1 type II CRISPR RNA-guided endonuclease Cas9 [*Streptococcus equinus*] SEQ ID NO: 148
WP_009854540.1 type II CRISPR RNA-guided endonuclease Cas9 [*Streptococcus* gallolyticus] SEQ ID NO: 149
WP_012962174.1 type II CRISPR RNA-guided endonuclease Cas9 [*Streptococcus* gallolyticus] SEQ ID NO: 150
WP_039695303.1 type II CRISPR RNA-guided endonuclease Cas9 [*Streptococcus gallolyticus*] SEQ ID NO: 151
WP_014334983.1 type II CRISPR RNA-guided endonuclease Cas9 [*Streptococcus infantarius*] SEQ ID NO: 152
WP_003099269.1 type II CRISPR RNA-guided endonuclease Cas9 [*Streptococcus iniae*] SEQ ID NO: 153
AHY15608.1 CRISPR-associated protein Csn1 [*Streptococcus iniae*] SEQ ID NO: 154
AHY17476.1 CRISPR-associated protein Csn1 [*Streptococcus iniae*] SEQ ID NO: 155
ESR09100.1 hypothetical protein IUSA1_08595 [*Streptococcus iniae* IUSA1] SEQ ID NO: 156
AGM98575.1 CRISPR-associated protein Cas9/Csn1, subtype II/NMEMI [*Streptococcus iniae* SF1] SEQ ID NO: 157
ALF27331.1 CRISPR-associated protein Csn1 [*Streptococcus intermedius*] SEQ ID NO: 158
WP_018372492.1 type II CRISPR RNA-guided endonuclease Cas9 [*Streptococcus massiliensis*] SEQ ID NO: 159
WP_045618028.1 type II CRISPR RNA-guided endonuclease Cas9 [*Streptococcus mitis*] SEQ ID NO: 160
WP_045635197.1 type II CRISPR RNA-guided endonuclease Cas9 [*Streptococcus mitis*] SEQ ID NO: 161
WP_002263549.1 type II CRISPR RNA-guided endonuclease Cas9 [*Streptococcus mutans*] SEQ ID NO: 162
WP_002263887.1 type II CRISPR RNA-guided endonuclease Cas9 [*Streptococcus mutans*] SEQ ID NO: 163
WP_002264920.1 type II CRISPR RNA-guided endonuclease Cas9 [*Streptococcus mutans*] SEQ ID NO: 164
WP_002269043.1 type II CRISPR RNA-guided endonuclease Cas9 [*Streptococcus mutans*] SEQ ID NO: 165
WP_002269448.1 type II CRISPR RNA-guided endonuclease Cas9 [*Streptococcus mutans*] SEQ ID NO: 166
WP_002271977.1 type II CRISPR RNA-guided endonuclease Cas9 [*Streptococcus mutans*] SEQ ID NO: 167
WP_002272766.1 type II CRISPR RNA-guided endonuclease Cas9 [*Streptococcus mutans*] SEQ ID NO: 168
WP_002273241.1 type II CRISPR RNA-guided endonuclease Cas9 [*Streptococcus mutans*] SEQ ID NO: 169
WP_002275430.1 type II CRISPR RNA-guided endonuclease Cas9 [*Streptococcus mutans*] SEQ ID NO: 170
WP_002276448.1 type II CRISPR RNA-guided endonuclease Cas9 [*Streptococcus mutans*] SEQ ID NO: 171
WP_002277050.1 type II CRISPR RNA-guided endonuclease Cas9 [*Streptococcus mutans*] SEQ ID NO: 172
WP_002277364.1 type II CRISPR RNA-guided endonuclease Cas9 [*Streptococcus mutans*] SEQ ID NO: 173
WP_002279025.1 type II CRISPR RNA-guided endonuclease Cas9 [*Streptococcus mutans*] SEQ ID NO: 174
WP_002279859.1 type II CRISPR RNA-guided endonuclease Cas9 [*Streptococcus mutans*] SEQ ID NO: 175
WP_002280230.1 type II CRISPR RNA-guided endonuclease Cas9 [*Streptococcus mutans*] SEQ ID NO: 176

WP_002281696.1 type II CRISPR RNA-guided endonuclease Cas9 [*Streptococcus mutans*] SEQ ID NO: 177
WP_002282247.1 type II CRISPR RNA-guided endonuclease Cas9 [*Streptococcus mutans*] SEQ ID NO: 178
WP_002282906.1 type II CRISPR RNA-guided endonuclease Cas9 [*Streptococcus mutans*] SEQ ID NO: 179
WP_002283846.1 type II CRISPR RNA-guided endonuclease Cas9 [*Streptococcus mutans*] SEQ ID NO: 180
WP_002287255.1 type II CRISPR RNA-guided endonuclease Cas9 [*Streptococcus mutans*] SEQ ID NO: 181
WP_002288990.1 type II CRISPR RNA-guided endonuclease Cas9 [*Streptococcus mutans*] SEQ ID NO: 182
WP_002289641.1 type II CRISPR RNA-guided endonuclease Cas9 [*Streptococcus mutans*] SEQ ID NO: 183
WP_002290427.1 type II CRISPR RNA-guided endonuclease Cas9 [*Streptococcus mutans*] SEQ ID NO: 184
WP_002295753.1 type II CRISPR RNA-guided endonuclease Cas9 [*Streptococcus mutans*] SEQ ID NO: 185
WP_002296423.1 type II CRISPR RNA-guided endonuclease Cas9 [*Streptococcus mutans*] SEQ ID NO: 186
WP_002304487.1 type II CRISPR RNA-guided endonuclease Cas9 [*Streptococcus mutans*] SEQ ID NO: 187
WP_002305844.1 type II CRISPR RNA-guided endonuclease Cas9 [*Streptococcus mutans*] SEQ ID NO: 188
WP_002307203.1 type II CRISPR RNA-guided endonuclease Cas9 [*Streptococcus mutans*] SEQ ID NO: 189
WP_002310390.1 type II CRISPR RNA-guided endonuclease Cas9 [*Streptococcus mutans*] SEQ ID NO: 190
WP_002352408.1 type II CRISPR RNA-guided endonuclease Cas9 [*Streptococcus mutans*] SEQ ID NO: 191
WP_012997688.1 type II CRISPR RNA-guided endonuclease Cas9 [*Streptococcus mutans*] SEQ ID NO: 192
WP_014677909.1 type II CRISPR RNA-guided endonuclease Cas9 [*Streptococcus mutans*] SEQ ID NO: 193
WP_019312892.1 type II CRISPR RNA-guided endonuclease Cas9 [*Streptococcus mutans*] SEQ ID NO: 194
WP_019313659.1 type II CRISPR RNA-guided endonuclease Cas9 [*Streptococcus mutans*] SEQ ID NO: 195
WP_019314093.1 type II CRISPR RNA-guided endonuclease Cas9 [*Streptococcus mutans*] SEQ ID NO: 196
WP_019315370.1 type II CRISPR RNA-guided endonuclease Cas9 [*Streptococcus mutans*] SEQ ID NO: 197
WP_019803776.1 type II CRISPR RNA-guided endonuclease Cas9 [*Streptococcus mutans*] SEQ ID NO: 198
WP_019805234.1 type II CRISPR RNA-guided endonuclease Cas9 [*Streptococcus mutans*] SEQ ID NO: 199
WP_024783594.1 type II CRISPR RNA-guided endonuclease Cas9 [*Streptococcus mutans*] SEQ ID NO: 200
WP_024784288.1 type II CRISPR RNA-guided endonuclease Cas9 [*Streptococcus mutans*] SEQ ID NO: 207
WP_024784666.1 type II CRISPR RNA-guided endonuclease Cas9 [*Streptococcus mutans*] SEQ ID NO: 208
WP_024784894.1 type II CRISPR RNA-guided endonuclease Cas9 [*Streptococcus mutans*] SEQ ID NO: 209
WP_024786433.1 type II CRISPR RNA-guided endonuclease Cas9 [*Streptococcus mutans*] SEQ ID NO: 210
WP_049473442.1 CRISPR-associated protein Csn1 [*Streptococcus mutans*] SEQ ID NO: 211
WP_049474547.1 CRISPR-associated protein Csn1 [*Streptococcus mutans*] SEQ ID NO: 212
EMC03581.1 hypothetical protein SMU69_09359 [*Streptococcus mutans* NLML4] SEQ ID NO: 213
WP_000428612.1 type II CRISPR RNA-guided endonuclease Cas9 [*Streptococcus* oral's] SEQ ID NO: 214
WP_000428613.1 type II CRISPR RNA-guided endonuclease Cas9 [*Streptococcus* oral's] SEQ ID NO: 215
WP_049523028.1 CRISPR-associated protein Csn1 [*Streptococcus parasanguinis*] SEQ ID NO: 216
WP_003107102.1 type II CRISPR RNA-guided endonuclease Cas9 [*Streptococcus parauberis*] SEQ ID NO: 217
WP_054279288.1 type II CRISPR RNA-guided endonuclease Cas9 [*Streptococcus phocae*] SEQ ID NO: 218
WP_049531101.1 CRISPR-associated protein Csn1 [*Streptococcus pseudopneumoniae*] SEQ ID NO: 219
WP_049538452.1 CRISPR-associated protein Csn1 [*Streptococcus pseudopneumoniae*] SEQ ID NO: 220
WP_049549711.1 CRISPR-associated protein Csn1 [*Streptococcus pseudopneumoniae*] SEQ ID NO: 221
WP_007896501.1 type II CRISPR RNA-guided endonuclease Cas9 [*Streptococcus pseudoporcinus*] SEQ ID NO: 222
EFR44625.1 CRISPR-associated protein, Csn1 family [*Streptococcus pseudoporcinus* SPIN 20026] SEQ ID NO: 223
WP_002897477.1 type II CRISPR RNA-guided endonuclease Cas9 [*Streptococcus sanguinis*] SEQ ID NO: 224
WP_002906454.1 type II CRISPR RNA-guided endonuclease Cas9 [*Streptococcus sanguinis*] SEQ ID NO: 225
WP_009729476.1 type II CRISPR RNA-guided endonuclease Cas9 [*Streptococcus* sp. F0441] SEQ ID NO: 226
CQR24647.1 CRISPR-associated protein [*Streptococcus* sp. FF10] SEQ ID NO: 227
WP_000066813.1 type II CRISPR RNA-guided endonuclease Cas9 [*Streptococcus* sp. M334] SEQ ID NO: 228
WP_009754323.1 type II CRISPR RNA-guided endonuclease Cas9 [*Streptococcus* sp. taxon 056] SEQ ID NO: 229
WP_044674937.1 type II CRISPR RNA-guided endonuclease Cas9 [*Streptococcus suis*] SEQ ID NO: 230
WP_044676715.1 type II CRISPR RNA-guided endonuclease Cas9 [*Streptococcus suis*] SEQ ID NO: 231
WP_044680361.1 type II CRISPR RNA-guided endonuclease Cas9 [*Streptococcus suis*] SEQ ID NO: 232
WP_044681799.1 type II CRISPR RNA-guided endonuclease Cas9 [*Streptococcus suis*] SEQ ID NO: 233
WP_049533112.1 CRISPR-associated protein Csn1 [*Streptococcus suis*] SEQ ID NO: 234
WP_029090905.1 type II CRISPR RNA-guided endonuclease Cas9 [*Brochothrix thermosphacta*] SEQ ID NO: 235
WP_006506696.1 type II CRISPR RNA-guided endonuclease Cas9 [*Catenibacterium mitsuokai*] SEQ ID NO: 236
AIT42264.1 Cas9hc:NLS:HA [Cloning vector pYB196] SEQ ID NO: 237
WP_034440723.1 type II CRISPR endonuclease Cas9 [Clostridiales bacterium S5-A11] SEQ ID NO: 238
AKQ21048.1 Cas9 [CRISPR-mediated gene targeting vector p(bhsp68-Cas9)] SEQ ID NO: 239
WP_004636532.1 type II CRISPR RNA-guided endonuclease Cas9 [*Dolosigranulum pigrum*] SEQ ID NO: 240
WP_002364836.1 MULTISPECIES: type II CRISPR RNA-guided endonuclease Cas9 [*Enterococcus*] SEQ ID NO: 241
WP_016631044.1 MULTISPECIES: type II CRISPR RNA-guided endonuclease Cas9 [*Enterococcus*] SEQ ID NO: 242 EMS75795.1 hypothetical protein H318_06676 [*Enterococcus durans* IPLA 655] SEQ ID NO: 243

WP_002373311.1 type II CRISPR RNA-guided endonuclease Cas9 [*Enterococcus faecalis*] SEQ ID NO: 244

WP_002378009.1 type II CRISPR RNA-guided endonuclease Cas9 [*Enterococcus faecalis*] SEQ ID NO: 245

WP_002407324.1 type II CRISPR RNA-guided endonuclease Cas9 [*Enterococcus faecalis*] SEQ ID NO: 246

WP_002413717.1 type II CRISPR RNA-guided endonuclease Cas9 [*Enterococcus faecalis*] SEQ ID NO: 247

WP_010775580.1 type II CRISPR RNA-guided endonuclease Cas9 [*Enterococcus faecalis*] SEQ ID NO: 248

WP_010818269.1 type II CRISPR RNA-guided endonuclease Cas9 [*Enterococcus faecalis*] SEQ ID NO: 249

WP_010824395.1 type II CRISPR RNA-guided endonuclease Cas9 [*Enterococcus faecalis*] SEQ ID NO: 250

WP_016622645.1 type II CRISPR RNA-guided endonuclease Cas9 [*Enterococcus faecalis*] SEQ ID NO: 251

WP_033624816.1 type II CRISPR RNA-guided endonuclease Cas9 [*Enterococcus faecalis*] SEQ ID NO: 252

WP_033625576.1 type II CRISPR RNA-guided endonuclease Cas9 [*Enterococcus faecalis*] SEQ ID NO: 253

WP_033789179.1 type II CRISPR RNA-guided endonuclease Cas9 [*Enterococcus faecalis*] SEQ ID NO: 254

WP_002310644.1 type II CRISPR RNA-guided endonuclease Cas9 [*Enterococcus faecium*] SEQ ID NO: 255

WP_002312694.1 type II CRISPR RNA-guided endonuclease Cas9 [*Enterococcus faecium*] SEQ ID NO: 256

WP_002314015.1 type II CRISPR RNA-guided endonuclease Cas9 [*Enterococcus faecium*] SEQ ID NO: 257

WP_002320716.1 type II CRISPR RNA-guided endonuclease Cas9 [*Enterococcus faecium*] SEQ ID NO: 258

WP_002330729.1 type II CRISPR RNA-guided endonuclease Cas9 [*Enterococcus faecium*] SEQ ID NO: 259

WP_002335161.1 type II CRISPR RNA-guided endonuclease Cas9 [*Enterococcus faecium*] SEQ ID NO: 260

WP_002345439.1 type II CRISPR RNA-guided endonuclease Cas9 [*Enterococcus faecium*] SEQ ID NO: 261

WP_034867970.1 type II CRISPR RNA-guided endonuclease Cas9 [*Enterococcus faecium*] SEQ ID NO: 262

WP_047937432.1 type II CRISPR RNA-guided endonuclease Cas9 [*Enterococcus faecium*] SEQ ID NO: 263

WP_010720994.1 type II CRISPR RNA-guided endonuclease Cas9 [*Enterococcus* hirae] SEQ ID NO: 264

WP_010737004.1 type II CRISPR RNA-guided endonuclease Cas9 [*Enterococcus* hirae] SEQ ID NO: 265

WP_034700478.1 type II CRISPR RNA-guided endonuclease Cas9 [*Enterococcus* hirae] SEQ ID NO: 266

WP_007209003.1 type II CRISPR RNA-guided endonuclease Cas9 [*Enterococcus italicus*] SEQ ID NO: 267

WP_023519017.1 type II CRISPR RNA-guided endonuclease Cas9 [*Enterococcus mundtil*] SEQ ID NO: 268

WP_010770040.1 type II CRISPR RNA-guided endonuclease Cas9 [*Enterococcus phoeniculicola*] SEQ ID NO: 269

WP_048604708.1 type II CRISPR RNA-guided endonuclease Cas9 [*Enterococcus* sp. AM1] SEQ ID NO: 270

WP_010750235.1 type II CRISPR RNA-guided endonuclease Cas9 [*Enterococcus villorum*] SEQ ID NO: 271

AII16583.1 Cas9 endonuclease [Expression vector pCas9] SEQ ID NO: 272

WP_029073316.1 type II CRISPR RNA-guided endonuclease Cas9 [*Kandleria vitulina*] SEQ ID NO: 273

WP_031589969.1 type II CRISPR RNA-guided endonuclease Cas9 [*Kandleria vitulina*] SEQ ID NO: 274

KDA45870.1 CRISPR-associated protein Cas9/Csn1, subtype II/NMEMI [*Lactobacillus animalis*] SEQ ID NO: 275

WP_039099354.1 type II CRISPR RNA-guided endonuclease Cas9 [*Lactobacillus curvatus*] SEQ ID NO: 521

AKP02966.1 hypothetical protein ABB45_04605 [*Lactobacillus farciminis*] SEQ ID NO: 522

WP_010991369.1 type II CRISPR RNA-guided endonuclease Cas9 [*Listeria innocua*] SEQ ID NO: 523

WP_033838504.1 type II CRISPR RNA-guided endonuclease Cas9 [*Listeria innocua*] SEQ ID NO: 524

EHN60060.1 CRISPR-associated protein, Csn1 family [*Listeria innocua* ATCC 33091] SEQ ID NO: 525

EFR89594.1 crispr-associated protein, Csn1 family [*Listeria innocua* FSL 54-378] SEQ ID NO: 526

WP_038409211.1 type II CRISPR RNA-guided endonuclease Cas9 [*Listeria ivanovii*] SEQ ID NO: 527

EFR95520.1 crispr-associated protein Csn1 [*Listeria ivanovii* FSL F6-596] SEQ ID NO: 528

WP_003723650.1 type II CRISPR RNA-guided endonuclease Cas9 [*Listeria monocytogenes*] SEQ ID NO: 529

WP_003727705.1 type II CRISPR RNA-guided endonuclease Cas9 [*Listeria monocytogenes*] SEQ ID NO: 530

WP_003730785.1 type II CRISPR RNA-guided endonuclease Cas9 [*Listeria monocytogenes*] SEQ ID NO: 531

WP_003733029.1 type II CRISPR RNA-guided endonuclease Cas9 [*Listeria monocytogenes*] SEQ ID NO: 532

WP_003739838.1 type II CRISPR RNA-guided endonuclease Cas9 [*Listeria monocytogenes*] SEQ ID NO: 533

WP_014601172.1 type II CRISPR RNA-guided endonuclease Cas9 [*Listeria monocytogenes*] SEQ ID NO: 534

WP_023548323.1 type II CRISPR RNA-guided endonuclease Cas9 [*Listeria monocytogenes*] SEQ ID NO: 535

WP_031665337.1 type II CRISPR RNA-guided endonuclease Cas9 [*Listeria monocytogenes*] SEQ ID NO: 536

WP_031669209.1 type II CRISPR RNA-guided endonuclease Cas9 [*Listeria monocytogenes*] SEQ ID NO: 537

WP_033920898.1 type II CRISPR RNA-guided endonuclease Cas9 [*Listeria monocytogenes*] SEQ ID NO: 538

AKI42028.1 CRISPR-associated protein [*Listeria monocytogenes*] SEQ ID NO: 539

AK150529.1 CRISPR-associated protein [*Listeria monocytogenes*] SEQ ID NO: 540

EFR83390.1 crispr-associated protein Csn1 [*Listeria monocytogenes* FSL F2-208] SEQ ID NO: 541

WP_046323366.1 type II CRISPR RNA-guided endonuclease Cas9 [*Listeria seeligeri*] SEQ ID NO: 542

AKE81011.1 Cas9 [Plant multiplex genome editing vector pYLCRISPR/Cas9Pubi-H] SEQ ID NO: 543

CU082355.1 Uncharacterized protein conserved in bacteria [*Roseburia hominis*] SEQ ID NO: 544

WP_033162887.1 type II CRISPR RNA-guided endonuclease Cas9 [*Sharpea azabuensis*] SEQ ID NO: 545

AGZ01981.1 Cas9 endonuclease [synthetic construct] SEQ ID NO: 546

AKA60242.1 nuclease deficient Cas9 [synthetic construct] SEQ ID NO: 547

AKS40380.1 Cas9 [Synthetic plasmid pFC330] SEQ ID NO: 548 4UN5_B Cas9, Chain B, Crystal Structure SEQ ID NO: 549

Cytosine Deaminase Domains

Nucleobase editors that convert a C to T, in some embodiments, comprise a cytosine deaminase. A "cytosine deaminase" refers to an enzyme that catalyzes the chemical reaction "cytosine+$H_2O$→uracil+$NH_3$" or "5-methyl-cytosine+$H_2O$→thymine+$NH_3$." As it may be apparent from the reaction formula, such chemical reactions result in a C to U/T nucleobase change. In the context of a gene, such a nucleotide change, or mutation, may in turn lead to an amino acid change in the protein, which may affect the protein's function, e.g., loss-of-function or gain-of-function. In some embodiments, the C to T nucleobase editor comprises a dCas9 or nCas9 fused to a cytosine deaminase. In some embodiments, the cytosine deaminase domain is fused to the N-terminus of the dCas9 or nCas9.

Non-limiting examples of suitable cytosine deaminase domains are provided below, as SEQ ID NOs: 276-298 and 487.

Human AID
(SEQ ID NO: 276)
MDSLLMNRRKFLYQFKNVRWAKGRRETYLCYVVKRRDSATSFSLD
FGYLRNKNGCHVELLFLRYISDWDLDPGRCYRVTWFTSWSPCYDC
ARHVADFLRGNPNLSLRIFTARLYFCEDRKAEPEGLRRLHRAGVQ
IAIMTFKDYFYCWNTFVENHERTFKAWEGLHENSVRLSRQLRRIL
LPLYEVDDLRDAFRTLGL Mouse AID
(SEQ ID NO: 277)
MDSLLMKQKKFLYHFKNVRWAKGRHETYLCYVVKRRDSATSCSLD
FGHLRNKSGCHVELLFLRYISDWDLDPGRCYRVTWFTSWSPCYDC
ARHVAEFLRWNPNLSLRIFTARLYFCEDRKAEPEGLRRLHRAGVQ
IGIMTFKDYFYCWNTFVENRERTFKAWEGLHENSVRLTRQLRRIL
LPLYEVDDLRDAFRMLGF Dog AID
(SEQ ID NO: 278)
MDSLLMKQRKFLYHFKNVRWAKGRHETYLCYVVKRRDSATSFSLD
FGHLRNKSGCHVELLFLRYISDWDLDPGRCYRVTWFTSWSPCYDC
ARHVADFLRGYPNLSLRIFAARLYFCEDRKAEPEGLRRLHRAGVQ
IAIMTFKDYFYCWNTFVENREKTFKAWEGLHENSVRLSRQLRRIL
LPLYEVDDLRDAFRTLGL Bovine AID
(SEQ ID NO: 279)
MDSLLKKQRQFLYQFKNVRWAKGRHETYLCYVVKRRDSPTSFSLD
FGHLRNKAGCHVELLFLRYISDWDLDPGRCYRVTWFTSWSPCYDC
ARHVADFLRGYPNLSLRIFTARLYFCDKERKAEPEGLRRLHRAGV
QIAIMTFKDYFYCWNTFVENHERTFKAWEGLHENSVRLSRQLRRI
LLPLYEVDDLRDAFRTLGL Mouse APOBEC-3
(SEQ ID NO: 280)
MGPFCLGCSHRKCYSPIRNLISQETFKFHFKNLGYAKGRKDTFLC
YEVTRKDCDSPVSLHHGVFKNKDNIHAEICFLYWFHDKVLKVLSP
REEFKITWYMSWSPCFECAEQIVRFLATHHNLSLDIFSSRLYNVQ
DPETQQNLCRLVQEGAQVAAMDLYEFKKCWKKFVDNGGRRFRPWK
RLLTNFRYQDSKLQEILRPCYIPVPSSSSSTLSNICLTKGLPETR
FCVEGRRMDPLSEEEFYSQFYNQRVKHLCYYHRMKPYLCYQLEQF
NGQAPLKGCLLSEKGKQHAEILFLDKIRSMELSQVTITCYLTWSP
CPNCAWQLAAFKRDRPDLILHIYTSRLYFHWKRPFQKGLCSLWQS -continued

GILVDVMDLPQFTDCWTNFVNPKRPFWPWKGLEIISRRTQRRLRR
IKESWGLQDLVNDFGNLQLGPPMS

Rat APOBEC-3
(SEQ ID NO: 281)
MGPFCLGCSHRKCYSPIRNLISQETFKFHFKNLRYAIDRKDTFLC
YEVTRKDCDSPVSLHHGVFKNKDNIHAEICFLYWFHDKVLKVLSP
REEFKITWYMSWSPCFECAEQVLRFLATHHNLSLDIFSSRLYNIR
DPENQQNLCRLVQEGAQVAAMDLYEFKKCWKKFVDNGGRRFRPWK
KLLTNFRYQDSKLQEILRPCYIPVPSSSSSTLSNICLTKGLPETR
FCVERRRVHLLSEEEFYSQFYNQRVKHLCYYHGVKPYLCYQLEQF
NGQAPLKGCLLSEKGKQHAEILFLDKIRSMELSQVIITCYLTWSP
CPNCAWQLAAFKRDRPDLILHIYTSRLYFHWKRPFQKGLCSLWQS
GILVDVMDLPQFTDCWTNFVNPKRPFWPWKGLEIISRRTQRRLHR
IKESWGLQDLVNDFGNLQLGPPMS

*Rhesus macaque* APOBEC-3G
(SEQ ID NO: 130)
MVEPMDPRTFVSNFNNRPILSGLNTVWLCCEVKTKDPSGPPLDAK
IFQGKVYSKAKYHPEMRFLRWFHKWRQLHHDQEYKVTWYVSWSPC
TRCANSVATFLAKDPKVTLTIFVARLYYFWKPDYQQALRILCQKR
GGPHATMKIMNYNEFQDCWNKFVDGRGKPFKPRNNLPKHYTLLQA
TLGELLRHLMDPGTFTSNFNNKPWVSGQHETYLCYKVERLHNDTW
VPLNQHRGFLRNQAPNIHGFPKGRHAELCFLDLIPFWKLDGQQYR
VTCFTSWSPCFSCAQEMAKFISNNEHVSLCIFAARIYDDQGRYQE
GLRALHRDGAKIAMMNYSEFEYCWDTFVDRQGRPFQPWDGLDEHS
QALSGRLRAI
(italic: nucleic acid editing domain;
underline: cytoplasmic localization signal)

Chimpanzee APOBEC-3G
(SEQ ID NO: 131)
MKPHFRNPVERMYQDTFSDNFYNRPILSHRNTVWLCYEVKTKGPS
RPPLDAKIFRGQVYSKLKYHPEMRFFHWFSKWRKLHRDQEYEVTW
YISWSPCTKCTRDVATFLAEDPKVTLTIFVARLYYFWDPDYQEAL
RSLCQKRDGPRATMKIMNYDEFQHCWSKFVYSQRELFEPWNNLPK
YYILLHIMLGEILRHSMDPPTFTSNFNNELWVRGRHETYLCYEVE
RLHNDTWVLLNQRRGFLCNQAPHKHGFLEGRHAELCFLDVIPFWK
LDLHQDYRVTCFTSWSPCFSCAQEMAKFISNNKHVSLCIFAARIY
DDQGRCQEGLRTLAKAGAKISIMTYSEFKHCWDTFVDHQGCPFQP
WDGLEEHSQALSGRLRAILQNQGN Green monkey APOBEC-3G
(SEQ ID NO: 132)
MNPQIRNMVEQMEPDIFVYYFNNRPILSGRNTVWLCYEVKTKDPS
GPPLDANIFQGKLYPEAKDHPEMKFLHWFRKWRQLHRDQEYEVTW
YVSWSPCTRCANSVATFLAEDPKVTLTIFVARLYYFWKPDYQQAL
RILCQERGGPHATMKIMNYNEFQHCWNEFVDGQGKPFKPRKNLPK
HYTLLHATLGELLRHVMDPGTFTSNFNNKPWVSGQRETYLCYKVE
RSHNDTWVLLNQHRGFLRNQAPDRHGFPKGRHAELCFLDLIPFWK LDDQQYRVTCFTSWSPCFSCAQKMAKFISNNKHVSLCIFAARIYD
DQGRCQEGLRTLHRDGAKIAVMNYSEFEYCWDTFVDRQGRPFQPW
DGLDEHSQALSGRLRAI Human APOBEC-3G (SEQ ID NO: 133)

MKPHFRNTVERMYRDTFSYNFYNRPILSRRNTVWLCYEVKTKGPS
RPPLDAKIFRGQVYSELKYHPEMRFFHWFSKWRKLHRDQEYEVTW
YISWSPCTKCTRDMATFLAEDPKVTLTIFVARLYYFWDPDYQEAL
RSLCQKRDGPRATMKIMNYDEFQHCWSKFVYSQRELFEPWNNLPK
YYILLHIMLGEILRHSMDPPTFTFNFNNEPWVRGRHETYLCYEVE
RMHNDTWVLLNQRRGFLCNQAPHKHGFLEGRHAELCFLDVIPFWK
LDLDQDYRVTCFTSWSPCFSCAQEMAKFISKNKHVSLCIFTARIY
DDQGRCQEGLRTLAEAGAKISIMTYSEFKHCWDTFVDHQGCPFQP
WDGLDEHSQDLSGRLRAILQNQEN

Human APOBEC-3F (SEQ ID NO: 134)

MKPHFRNTVERMYRDTFSYNFYNRPILSRRNTVWLCYEVKTKGPS
RPRLDAKIFRGQVYSQPEHHAEMCFLSWFCGNQLPAYKCFQITWF
VSWTPCPDCVAKLAEFLAEHPNVTLTISAARLYYYWERDYRRALC
RLSQAGARVKIMDDEEFAYCWENFVYSEGQPFMPWYKFDDNYAFL
HRTLKEILRNPMEAMYPHIFYFHFKNLRKAYGRNESWLCFTMEVV
KHHSPVSWKRGVFRNQVDPETHCHAERCFLSWFCDDILSPNTNYE
VTWYTSWSPCPECAGEVAEFLARHSNVNLTIFTARLYYFWDTDYQ
EGLRSLSQEGASVEIMGYKDFKYCWENFVYNDDEPFKPWKGLKYN
FLFLDSKLQEILE

Human APOBEC-3B (SEQ ID NO: 135)

MNPQIRNPMERMYRDTFYDNFENEPILYGRSYTWLCYEVKIKRGR
SNLLWDTGVFRGQVYFKPQYHAEMCFLSWFCGNQLPAYKCFQITW
FVSWTPCPDCVAKLAEFLSEHPNVTLTISAARLYYYWERDYRRAL
CRLSQAGARVTIMDYEEFAYCWENFVYNEGQQFMPWYKFDENYAF
LHRTLKEILRYLMDPDTFTFNFNNDPLVLRRRQTYLCYEVERLDN
GTWVLMDQHMGFLCNEAKNLLCGFYGRHAELRFLDLVPSLQLDPA
QIYRVTWFISWSPCFSWGCAGEVRAFLQENTHVRLRIFAARIYDY
DPLYKEALQMLRDAGAQVSIMTYDEFEYCWDTFVYRQGCPFQPWD
GLEEHSQALSGRLRAILQNQGN

Human APOBEC-3C:

(SEQ ID NO: 137)

MNPQIRNPMKAMYPGTFYFQFKNLWEANDRNETWLCFTVEGIKRR
SVVSWKTGVFRNQVDSETHCHAERCFLSWFCDDILSPNTKYQVTW
YTSWSPCPDCAGEVAEFLARHSNVNLTIFTARLYYFQYPCYQEGL
RSLSQEGVAVEIMDYEDFKYCWENFVYNDNEPFKPWKGLKTNFRL
LKRRLRESLQ

Human APOBEC-3A:

(SEQ ID NO: 138)

MEASPASGPRHLMDPHIFTSNFNNGIGRHKTYLCYEVERLDNGTS
VKMDQHRGFLHNQAKNLLCGFYGRHAELRFLDLVPSLQLDPAQIY
RVTWFISWSPCFSWGCAGEVRAFLQENTHVRLRIFAARIYDYDPL
YKEALQMLRDAGAQVSIMTYDEFKHCWDTFVDHQGCPFQPWDGLD
EHSQALSGRLRAILQNQGN

Human APOBEC-3H:

(SEQ ID NO: 139)

MALLTAETFRLQFNNKRRLRRPYYPRKALLCYQLTPQNGSTPTRG
YFENKKKCHAEICFINEIKSMGLDETQCYQVTCYLTWSPCSSCAW
ELVDFIKAHDHLNLGIFASRLYYHWCKPQQKGLRLLCGSQVPVEV
MGFPKFADCWENFVDHEKPLSFNPYKMLEELDKNSRAIKRRLERI
KIPGVRAQGRYMDILCDAEV

Human APOBEC-3D (SEQ ID NO: 140)

MNPQIRNPMERMYRDTFYDNFENEPILYGRSYTWLCYEVKIKRGR
SNLLWDTGVFRGPVLPKRQSNHRQEVYFRFENHAEMCFLSWFCGN
RLPANRRFQITWFVSWNPCLPCVVKVTKFLAEHPNVTLTISAARL
YYYRDRDWRWVLLRLHKAGARVKIMDYEDFAYCWENFVCNEGQPF
MPWYKFDDNYASLHRTLKEILRNPMEAMYPHIFYFHFKNLLKACG
RNESWLCFTMEVTKHHSAVFRKRGVFRNQVDPETHCHAERCFLSW
FCDDILSPNTNYEVTWYTSWSPCPECAGEVAEFLARHSNVNLTIF
TARLCYFWDTDYQEGLCSLSQEGASVKIMGYKDFVSCWKNFVYSD
DEPFKPWKGLQTNFRLLKRRLREILQ

Human APOBEC-1

(SEQ ID NO: 292)

MTSEKGPSTGDPTLRRRIEPWEFDVFYDPRELRKEACLLYEIKWG
MSRKIWRSSGKNTTNHVEVNFIKKFTSERDFHPSMSCSITWFLSW
SPCWECSQAIREFLSRHPGVTLVIYVARLFWHMDQQNRQGLRDLV
NSGVTIQIMRASEYYHCWRNFVNYPPGDEAHWPQYPPLWMMLYAL
ELHCIILSLPPCLKISRRWQNHLTFFRLHLQNCHYQTIPPHILLA
TGLIHPSVAWR

Mouse APOBEC-1

(SEQ ID NO: 293)

MSSETGPVAVDPTLRRRIEPHEFEVFFDPRELRKETCLLYEINWG
GRHSVWRHTSQNTSNHVEVNFLEKFTTERYFRPNTRCSITWFLSW
SPCGECSRAITEFLSRHPYVTLFIYIARLYHHTDQRNRQGLRDLI
SSGVTIQIMTEQEYCYCWRNFVNYPPSNEAYWPRYPHLWVKLYVL
ELYCIILGLPPCLKILRRKQPQLTFFTITLQTCHYQRIPPHLLWA
TGLK

Rat APOBEC-1

(SEQ ID NO: 294)

MSSETGPVAVDPTLRRRIEPHEFEVFFDPRELRKETCLLYEINWG
GRHSIWRHTSQNTNKHVEVNFIEKFTTERYFCPNTRCSITWFLSW
SPCGECSRAITEFLSRYPHVTLFIYIARLYHHADPRNRQGLRDLI

-continued

SSGVTIQIMTEQESGYCWRNFVNYSPSNEAHWPRYPHLWVRLYVL
ELYCIILGLPPCLNILRRKQPQLTFFTIALQSCHYQRLPPHILWA
TGLK

Petromyzon marinus CDA1 (pmCDA1)
(SEQ ID NO: 295)
MTDAEYVRIHEKLDIYTFKKQFFNNKKSVSHRCYVLFELKRRGER
RACFWGYAVNKPQSGTERGIHAEIFSIRKVEEYLRDNPGQFTINW
YSSWSPCADCAEKILEWYNQELRGNGHTLKIWACKLYYEKNARNQ
IGLWNLRDNGVGLNVMVSEHYQCCRKIFIQSSHNQLNENRWLEKT
LKRAEKRRSELSIMIQVKILHTTKSPAV Evolved pmCDA1 (evoCDA1)
(SEQ ID NO: 487)
MTDAEYVRIHEKLDIYTFKKQFSNNKKSVSHRCYVLFELKRRGER
RACFWGYAVNKPQSGTERGIHAEIFSIRKVEEYLRDNPGQFTINW
YSSWSPCADCAEKILEWYNQELRGNGHTLKIWVCKLYYEKNARNQ
IGLWNLRDNGVGLNVMVSEHYQCCRKIFIQSSHNQLNENRWLEKT
LKRAEKRRSELSIMFQVKILHTTKSPAV Human APOBEC3G D316R_D317R
(SEQ ID NO: 296)
MKPHFRNTVERMYRDTFSYNFYNRPILSRRNTVWLCYEVKTKGPS
RPPLDAKIFRGQVYSELKYHPEMRFFHWFSKWRKLHRDQEYEVTW
YISWSPCTKCTRDMATFLAEDPKVTLTIFVARLYYFWDPDYQEAL
RSLCQKRDGPRATMKIMNYDEFQHCWSKFVYSQRELFEPWNNLPK
YYILLHIMLGEILRHSMDPPTFTFNFNNEPWVRGRHETYLCYEVE
RMHNDTWVLLNQRRGFLCNQAPHKHGFLEGRHAELCFLDVIPFWK
LDLDQDYRVTCFTSWSPCFSCAQEMAKFISKNKHVSLCIFTARIY
RRQGRCQEGLRTLAEAGAKISIMTYSEFKHCWDTFVDHQGCPFQP
WDGLDEHSQDLSGRLRAILQNQEN Human APOBEC3G chain A
(SEQ ID NO: 297)
MDPPTFTFNFNNEPWVRGRHETYLCYEVERMHNDTWVLLNQRRGF
LCNQAPHKHGFLEGRHAELCFLDVIPFWKLDLDQDYRVTCFTSWS
PCFSCAQEMAKFISKNKHVSLCIFTARIYDDQGRCQEGLRTLAEA
GAKISIMTYSEFKHCWDTFVDHQGCPFQPWDGLDEHSQDLSGRLR
AILQ Human APOBEC3G chain A D120R_D121R
(SEQ ID NO: 298)
MDPPTFTFNFNNEPWVRGRHETYLCYEVERMHNDTWVLLNQRRGF
LCNQAPHKHGFLEGRHAELCFLDVIPFWKLDLDQDYRVTCFTSWS
PCFSCAQEMAKFISKNKHVSLCIFTARIYRRQGRCQEGLRTLAEA
GAKISIMTYSEFKHCWDTFVDHQGCPFQPWDGLDEHSQDLSGRLR
AILQ Adenosine Deaminase Domains In some embodiments, a nucleobase editor converts an A to G. In some embodiments, the nucleobase editor comprises an adenosine deaminase. An "adenosine deaminase" is an enzyme involved in purine metabolism. It is needed for the breakdown of adenosine from food and for the turnover of nucleic acids in tissues. Its primary function in humans is the development and maintenance of the immune system. An adenosine deaminase catalyzes hydrolytic deamination of adenosine (forming inosine, which base pairs as G) in the context of DNA. There are no known adenosine deaminases that act on DNA. Instead, known adenosine deaminase enzymes only act on RNA (tRNA or mRNA). Evolved deoxyadenosine deaminase enzymes that accept DNA substrates and deaminate dA to deoxyinosine and here use in adenosine nucleobase editors have been described, e.g., in PCT Application PCT/US2017/045381, filed Aug. 3, 2017, which published as WO 2018/027078, PCT Application No. PCT/US2019/033848, which published as WO 2019/226953, PCT Application No PCT/US2019/033848, filed May 23, 2019, and PCT Application No. PCT/US2020/028568, filed Apr. 17, 2020; each of which is herein incorporated by reference by reference. Non-limiting examples of evolved adenosine deaminases that accept DNA as substrates are provided below.

Non-limiting examples evolved adenosine deaminases that accept DNA as substrates that are suitable for use as adenosine deaminase domains of the disclosed adenine nucleobase editors are provided below. In some embodiments, the adenosine deaminase domain of any of the disclosed nucleobase editors comprises an amino acid sequence having at least 85% identity, at least 90% identity, at least 95% identity, at least 98% identity, or at least 99% identity to an amino acid sequence comprising SEQ ID NO: 141, 314-321, 358, 407, 409-420, 422-424, 426-431, 433, 434, 438-457, 491-495, and 514.

In some embodiments, the adenosine deaminase domain of any of the disclosed nucleobase editors comprises an amino acid sequence having at least 85% identity, at least 90% identity, at least 95% identity, at least 98% identity, or at least 99% identity to an amino acid sequence comprising SEQ ID NO: 492 (TadA 7.10). In some embodiments, the adenosine deaminase domain of the disclosed nucleobase editors comprise an amino acid sequence comprising SEQ ID NO: 492.

In some embodiments, the adenosine deaminase domain of any of the disclosed nucleobase editors comprises an amino acid sequence having at least 85% identity, at least 90% identity, at least 95% identity, at least 98% identity, or at least 99% identity to an amino acid sequence comprising SEQ ID NO: 494 (TadA-8e). In some embodiments, the adenosine deaminase domain of the disclosed nucleobase editors comprise an amino acid sequence comprising SEQ ID NO: 494.

ecTadA
(SEQ ID NO: 314)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILADEC
AALLSDFFRMRRQEIKAQKKAQSSTD

-continued ecTadA (D108N)

(SEQ ID NO: 315)

SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARNAKTGAAGSLMDVLHHPGMNHRVEITEGILADEC

AALLSDFFRMRRQEIKAQKKAQSSTD ecTadA (D108G)

(SEQ ID NO: 316)

SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARGAKTGAAGSLMDVLHHPGMNHRVEITEGILADEC

AALLSDFFRMRRQEIKAQKKAQSSTD ecTadA (D108V)

(SEQ ID NO: 317)

SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARVAKTGAAGSLMDVLHHPGMNHRVEITEGILADEC

AALLSDFFRMRRQEIKAQKKAQSSTD ecTadA (H8Y, D108N, N1275)

(SEQ ID NO: 318)

SEVEFSYEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARNAKTGAAGSLMDVLHHPGMSHRVEITEGILADEC

AALLSDFFRMRRQEIKAQKKAQSSTD ecTadA (H8Y, D108N, N1275, E155D)

(SEQ ID NO: 319)

SEVEFSYEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARNAKTGAAGSLMDVLHHPGMSHRVEITEGILADEC

AALLSDFFRMRRQDIKAQKKAQSSTD ecTadA (H8Y, D108N, N1275, E155G)

(SEQ ID NO: 320)

SEVEFSYEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARNAKTGAAGSLMDVLHHPGMSHRVEITEGILADEC

AALLSDFFRMRRQGIKAQKKAQSSTD ecTadA (H8Y, D108N, N127S, E155V)

(SEQ ID NO: 321)

SEVEFSYEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARNAKTGAAGSLMDVLHHPGMSHRVEITEGILADEC

AALLSDFFRMRRQVIKAQKKAQSSTD ecTadA (A106V, D108N, D147Y, andE155V)

(SEQ ID NO: 407)

SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGVRNAKTGAAGSLMDVLHHPGMNHRVEITEGILADEC

AALLSYFFRMRRQVIKAQKKAQSSTD ecTadA (S2A, I49F, A106V, D108N, D147Y, E155V)

(SEQ ID NO: 409)

AEVEFSHEYWMRHALTLAKRAWDEREVPVGAVLVHNNRVIGEGWNRPFGRHDPTAHAEIMALRQGGLVM

QNYRLIDATLYVTLEPCVMCAGAMIHSRIGRVVFGVRNAKTGAAGSLMDVLHHPGMNHRVEITEGILADEC

AALLSYFFRMRRQVIKAQKKAQSSTD ecTadA (H8Y, A106T, D108N, N1275, K1605)

(SEQ ID NO: 410)

SEVEFSYEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGTRNAKTGAAGSLMDVLHHPGMSHRVEITEGILADEC

AALLSDFFRMRRQEIKAQSKAQSSTD

-continued ecTadA (R26G, L84F, A106V, R107H, D108N, H123Y, A142N, A143D, D147Y, E155V, I156F)
(SEQ ID NO: 411)
SEVEFSHEYWMRHALTLAKRAWDEGEVPVGAVLVHNNRVIGEGWNRPIGRHDPTAHAEIMALRQGGLVM

QNYRLIDATLYVTFEPCVMCAGAMIHSRIGRVVFGVHNAKTGAAGSLMDVLHYPGMNHRVEITEGILADEC

NDLLSYFFRMRRQVFKAQKKAQSSTD ecTadA (E25G, R26G, L84F, A106V, R107H, D108N, H123Y,
(SEQ ID NO: 412)
A142N, A143D, D147Y, E155V, I156F)
SEVEFSHEYWMRHALTLAKRAWDGGEVPVGAVLVHNNRVIGEGWNRPIGRHDPTAHAEIMALRQGGLVM

QNYRLIDATLYVTFEPCVMCAGAMIHSRIGRVVFGVHNAKTGAAGSLMDVLHYPGMNHRVEITEGILADEC

NDLLSYFFRMRRQVFKAQKKAQSSTD ecTadA (E25D, R26G, L84F, A106V, R107K, D108N, H123Y, A142N, A143G, D147Y, E155V, I156F)
(SEQ ID NO: 413)
SEVEFSHEYWMRHALTLAKRAWDDGEVPVGAVLVHNNRVIGEGWNRPIGRHDPTAHAEIMALRQGGLVM

QNYRLIDATLYVTFEPCVMCAGAMIHSRIGRVVFGVKNAKTGAAGSLMDVLHYPGMNHRVEITEGILADEC

NGLLSYFFRMRRQVFKAQKKAQSSTD ecTadA (R26Q, L84F, A106V, D108N, H123Y, A142N, D147Y, E155V, I156F)
(SEQ ID NO: 414)
SEVEFSHEYWMRHALTLAKRAWDEQEVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

NALLSYFFRMRRQVFKAQKKAQSSTD ecTadA (E25M, R26G, L84F, A106V, R107P, D108N, H123Y, A142N, A143D, D147Y, E155V, I156F)
(SEQ ID NO: 415)
SEVEFSHEYWMRHALTLAKRAWDMGEVPVGAVLVHNNRVIGEGWNRPIGRHDPTAHAEIMALRQGGLVM

QNYRLIDATLYVTFEPCVMCAGAMIHSRIGRVVFGVPNAKTGAAGSLMDVLHYPGMNHRVEITEGILADEC

NDLLSYFFRMRRQVFKAQKKAQSSTD ecTadA
(R26C, L84F, A106V, R107H, D108N, H123Y, A142N, D147Y, E155V, I156F)
(SEQ ID NO: 416)
SEVEFSHEYWMRHALTLAKRAWDECEVPVGAVLVHNNRVIGEGWNRPIGRHDPTAHAEIMALRQGGLVM

QNYRLIDATLYVTFEPCVMCAGAMIHSRIGRVVFGVHNAKTGAAGSLMDVLHYPGMNHRVEITEGILADEC

NALLSYFFRMRRQVFKAQKKAQSSTD ecTadA (L84F, A106V, D108N, H123Y, A142N, A143L, D147Y, E155V, I156F)
(SEQ ID NO: 417)
SEVEFSHEYWMRHALTLAKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

NLLLSYFFRMRRQVFKAQKKAQSSTD ecTadA (R26G, L84F, A106V, D108N, H123Y, A142N, D147Y, E155V, I156F)
(SEQ ID NO: 418)
SEVEFSHEYWMRHALTLAKRAWDEGEVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

NALLSYFFRMRRQVFKAQKKAQSSTD ecTadA (R51H, L84F, A106V, D108N, H123Y, D147Y, E155V, I156F, K157N)
(SEQ ID NO: 419)
SEVEFSHEYWMRHALTLAKRAWDEREVPVGAVLVHNNRVIGEGWNRPIGHHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLSYFFRMRRQVFNAQKKAQSSTD

-continued ecTadA (E25A, R26G, L84F, A106V, R107N, D108N, H123Y, A142N, A143E, D147Y, E155V, I156F)
(SEQ ID NO: 420)
SEVEFSHEYWMRHALTLAKRAWDAGEVPVGAVLVHNNRVIGEGWNRPIGRHDPTAHAEIMALRQGGLVM

QNYRLIDATLYVTFEPCVMCAGAMIHSRIGRVVFGVNNAKTGAAGSLMDVLHYPGMNHRVEITEGILADEC

NELLSYFFRMRRQVFKAQKKAQSSTD ecTadA (N37T, P48T, L84F, A106V, D108N, H123Y, D147Y, E155V, I156F)
(SEQ ID NO: 422)
SEVEFSHEYWMRHALTLAKRAWDEREVPVGAVLVHTNRVIGEGWNRTIGRHDPTAHAEIMALRQGGLVM

QNYRLIDATLYVTFEPCVMCAGAMIHSRIGRVVFGVRNAKTGAAGSLMDVLHYLHY-
PGMNHRVEITEGILADEC

AALLSYFFRMRRQVFKAQKKAQSSTD ecTadA (N375, L84F, A106V, D108N, H123Y, D147Y, E155V, I156F)
(SEQ ID NO: 423)
SEVEFSHEYWMRHALTLAKRAWDEREVPVGAVLVHSNRVIGEGWNRPIGRHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLSYFFRMRRQVFKAQKKAQSSTD ecTadA (H36L, L84F, A106V, D108N, H123Y, D147Y, E155V, I156F)
(SEQ ID NO: 424)
SEVEFSHEYWMRHALTLAKRAWDEREVPVGAVLVLNNRVIGEGWNRPIGRHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLSYFFRMRRQVFKAQKKAQSSTD ecTadA (H36L, P48L, L84F, A106V, D108N, H123Y, D147Y, E155V, I156F)
(SEQ ID NO: 426)
SEVEFSHEYWMRHALTLAKRAWDEREVPVGAVLVLNNRVIGEGWNRLIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLSYFFRMRRQVFKAQKKAQSSTD ecTadA (H36L, L84F, A106V, D108N, H123Y, D147Y, E155V, K57N, I156F)
(SEQ ID NO: 427)
SEVEFSHEYWMRHALTLAKRAWDEREVPVGAVLVLNNRVIGEGWNRPIGRHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLSYFFRMRRQVFNAQKKAQSSTD ecTadA (H36L, L84F, A106V, D108N, H123Y, 5146C, D147Y, E155V, I156F)
(SEQ ID NO: 428)
SEVEFSHEYWMRHALTLAKRAWDEREVPVGAVLVLNNRVIGEGWNRPIGRHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLCYFFRMRRQVFKAQKKAQSSTD ecTadA (L84F, A106V, D108N, H123Y, 5146R, D147Y, E155V, I156F)
(SEQ ID NO: 429)
SEVEFSHEYWMRHALTLAKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLRYFFRMRRQVFKAQKKAQSSTD ecTadA (N375, R51H, L84F, A106V, D108N, H123Y, D147Y, E155V, I156F
(SEQ ID NO: 430)
SEVEFSHEYWMRHALTLAKRAWDEREVPVGAVLVHSNRVIGEGWNRPIGHHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLSYFFRMRRQVFKAQKKAQSSTD

-continued ecTadA (R51L, L84F, A106V, D108N, H123Y, D147Y, E155V, I156F, K157N (SEQ ID NO: 431)

SEVEFSHEYWMRHALTLAKRAWDEREVPVGAVLVHNNRVIGEGWNRPIGLHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLSYFFRMRRQVFNAQKKAQSSTD saTadA (D108N)

(SEQ ID NO: 433)

GSHMTNDIYFMTLAIEEAKKAAQLGEVPIGAIITKDDEVIARAHNLRETLQQPTAHAEHIAIERAAKVLGSWR

LEGCTLYVTLEPCVMCAGTIVMSRIPRVVYGADNPKGGCSGSLMNLLQQSNFNHRAIVDKGVLKEACSTLLT

TFFKNLRANKKSTN saTadA (D107A_D108N)

(SEQ ID NO: 434)

GSHMTNDIYFMTLAIEEAKKAAQLGEVPIGAIITKDDEVIARAHNLRETLQQPTAHAEHIAIERAAKVLGSWR

LEGCTLYVTLEPCVMCAGTIVMSRIPRVVYGAANPKGGCSGSLMNLLQQSNFNHRAIVDKGVLKEACSTLLT

TFFKNLRANKKSTN saTadA (G26P_D107A_D108N)

(SEQ ID NO: 141)

GSHMTNDIYFMTLAIEEAKKAAQLPEVPIGAIITKDDEVIARAHNLRETLQQPTAHAEHIAIERAAKVLGSWR

LEGCTLYVTLEPCVMCAGTIVMSRIPRVVYGAANPKGGCSGSLMNLLQQSNFNHRAIVDKGVLKEACSTLLT

TFFKNLRANKKSTN saTadA (G26P_D107A_D108N_S142A)

(SEQ ID NO: 358)

GSHMTNDIYFMTLAIEEAKKAAQLPEVPIGAIITKDDEVIARAHNLRETLQQPTAHAEHIAIERAAKVLGSWR

LEGCTLYVTLEPCVMCAGTIVMSRIPRVVYGAANPKGGCSGSLMNLLQQSNFNHRAIVDKGVLKEACATLL

TTFFKNLRANKKSTN saTadA (D107A_D108N_S142A)

(SEQ ID NO: 514)

GSHMTNDIYFMTLAIEEAKKAAQLGEVPIGAIITKDDEVIARAHNLRETLQQPTAHAEHIAIERAAKVLGSWR

LEGCTLYVTLEPCVMCAGTIVMSRIPRVVYGAANPKGGCSGSLMNLLQQSNFNHRAIVDKGVLKEACATLL

TTFFKNLRANKKSTN ecTadA (P48S)

(SEQ ID NO: 438)

SEVEFSHEYWMRHALTLAKRAWDEREVPVGAVLVHNNRVIGEGWNRSIGRHDPTAHAEIMALRQGGLVM

QNYRLIDATLYVTLEPCVMCAGAMIHSRIGRVVFGARDAKTGAAGSLMDVLHHPGMNHRVEITEGILADEC

AALLSDFFRMRRQEIKAQKKAQSSTD ecTadA (P48T)

(SEQ ID NO: 439)

SEVEFSHEYWMRHALTLAKRAWDEREVPVGAVLVHNNRVIGEGWNRTIGRHDPTAHAEIMALRQGGLVM

QNYRLIDATLYVTLEPCVMCAGAMIHSRIGRVVFGARDAKTGAAGSLMDVLHHPGMNHRVEITEGILADEC

AALLSDFFRMRRQEIKAQKKAQSSTD ecTadA (P48A)

(SEQ ID NO: 440)

SEVEFSHEYWMRHALTLAKRAWDEREVPVGAVLVHNNRVIGEGWNRAIGRHDPTAHAEIMALRQGGLVM

QNYRLIDATLYVTLEPCVMCAGAMIHSRIGRVVFGARDAKTGAAGSLMDVLHHPGMNHRVEITEGILADEC

AALLSDFFRMRRQEIKAQKKAQSSTD ecTadA (A142N)

(SEQ ID NO: 441)

SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARDAKTGAAGSLMDVLHHPGMNHRVEITEGILADEC

NALLSDFFRMRRQEIKAQKKAQSSTD

-continued ecTadA (W23R)
(SEQ ID NO: 442)
SEVEFSHEYWMRHALTLAKRARDEREVPVGAVLVHNNRVIGEGWNRPIGRHDPTAHAEIMALRQGGLVMQ

NYRLIDATLYVTLEPCVMCAGAMIHSRIGRVVFGARDAKTGAAGSLMDVLHHPGMNHRVEITEGILADECA

ALLSDFFRMRRQEIKAQKKAQSSTD ecTadA (W23L)
(SEQ ID NO: 443)
SEVEFSHEYWMRHALTLAKRALDEREVPVGAVLVHNNRVIGEGWNRPIGRHDPTAHAEIMALRQGGLVMQ

NYRLIDATLYVTLEPCVMCAGAMIHSRIGRVVFGARDAKTGAAGSLMDVLHHPGMNHRVEITEGILADECA

ALLSDFFRMRRQEIKAQKKAQSSTD ecTadA (R152P)
(SEQ ID NO: 444)
SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARDAKTGAAGSLMDVLHHPGMNHRVEITEGILADEC

AALLSDFFRMPRQEIKAQKKAQSSTD ecTadA (R152H)
(SEQ ID NO: 445)
SEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARDAKTGAAGSLMDVLHHPGMNHRVEITEGILADEC

AALLSDFFRMHRQEIKAQKKAQSSTD ecTadA (L84F, A106V, D108N, H123Y, D147Y, E155V, I156F)
(SEQ ID NO: 446)
SEVEFSHEYWMRHALTLAKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLSYFFRMRRQVFKAQKKAQSSTD ecTadA (H36L, R51L, L84F, A106V, D108N, H123Y, S146C, D147Y, E155V, I156F, K157N)
(SEQ ID NO: 447)
SEVEFSHEYWMRHALTLAKRAWDEREVPVGAVLVLNNRVIGEGWNRPIGLHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLCYFFRMRRQVFNAQKKAQSSTD ecTadA (H36L, P48S, R51L, L84F, A106V, D108N, H123Y, 5146C, D147Y, E155V, I156F, K157N)
(SEQ ID NO: 448)
SEVEFSHEYWMRHALTLAKRAWDEREVPVGAVLVLNNRVIGEGWNRSIGLHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLCYFFRMRRQVFNAQKKAQSSTD ecTadA (H36L, P48A, R51L, L84F, A106V, D108N, H123Y, 5146C, D147Y, E155V, I156F, K157N)
(SEQ ID NO: 449)
SEVEFSHEYWMRHALTLAKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLCYFFRMRRQVFNAQKKAQSSTD ecTadA (W23L, H36L, P48A, R51L, L84F, A106V, D108N, H123Y, 5146C, D147Y, R152P, E155V, I156F, K157N)
(SEQ ID NO: 450)
SEVEFSHEYWMRHALTLAKRALDEREVPVGAVLVLNNRVIGEGWNRAIGLHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLCYFFRMPRQVFNAQKKAQSSTD

-continued ecTadA (W23R, H36L, P48A, R51L, L84F, A106V, D108N, H123Y, 5146C, D147Y, R152P, E155V, I156F, K157N)

(SEQ ID NO: 479)
SEVEFSHEYWMRHALTLAKRALDEREVPVGAVLVLNNRVIGEGWNRAIGLHDPTAHAEIMALRQGGLVMQ

NYRLIDATLYVTFEPCVMCAGAMIHSRIGRVVFGVRNAKTGAAGSLMDVLHYPGMNHRVEITEGILADECA

ALLCYFFRMPRQVFNAQKKAQSSTD

*Staphylococcus aureus* TadA:

(SEQ ID NO: 451)
MGSHMTNDIYFMTLAIEEAKKAAQLGEVPIGAIITKDDEVIARAHNLRETLQQPTAHAEHIAIERAAKVLGSW

RLEGCTLYVTLEPCVMCAGTIVMSRIPRVVYGADDPKGGCSGSLMNLLQQSNFNHRAIVDKGVLKEACSTL

LTTFFKNLRANKKSTN

*Bacillus subtilis* TadA:

(SEQ ID NO: 452)
MTQDELYMKEAIKEAKKAEEKGEVPIGAVLVINGEIIARAHNLRETEQRSIAHAEMLVIDEACKALGTWRLE

GATLYVTLEPCPMCAGAVVLSRVEKVVFGAFDPKGGCSGTLMNLLQEERFNHQAEVVSGVLEEECGGMLS

AFFRELRKKKKAARKNLSE

*Salmonella typhimurium* (*S. typhimurium*) TadA:

(SEQ ID NO: 453)
MPPAFITGVTSLSDVELDHEYWMRHALTLAKRAWDEREVPVGAVLVHNHRVIGEGWNRPIGRHDPTAHAEI

MALRQGGLVLQNYRLLDTTLYVTLEPCVMCAGAMVHSRIGRVVFGARDAKTGAAGSLIDVLHHPGMNHR

VEIIEGVLRDECATLLSDFFRMRRQEIKALKKADRAEGAGPAV

*Shewanella putrefaciens* (*S. putrefaciens*)TadA:

(SEQ ID NO: 454)
MDEYWMQVAMQMAEKAEAAGEVPVGAVLVKDGQQIATGYNLSISQHDPTAHAEILCLRSAGKKLENYRL

LDATLYITLEPCAMCAGAMVHSRIARVVYGARDEKTGAAGTVVNLLQHPAFNHQVEVTSGVLAEACSAQL

SRFFKRRRDEKKALKLAQRAQQGIE

*Haemophilus influenzae* F3031 (*H. influenzae*) TadA:

(SEQ ID NO: 455)
MDAAKVRSEFDEKMMRYALELADKAEALGEIPVGAVLVDDARNIIGEGWNLSIVQSDPTAHAEIIALRNGA

KNIQNYRLLNSTLYVTLEPCTMCAGAILHSRIKRLVFGASDYKTGAIGSRFHFFDDYKMNHTLEITSGVLAEE

CSQKLSTFFQKRREEKKIEKALLKSLSDK

*Caulobacter crescentus* (*C. crescentus*) TadA:

(SEQ ID NO: 456)
MRTDESEDQDHRMMRLALDAARAAAEAGETPVGAVILDPSTGEVIATAGNGPIAAHDPTAHAEIAAMRAA

AAKLGNYRLTDLTLVVTLEPCAMCAGAISHARIGRVVFGADDPKGGAVVHGPKFFAQPTCHWRPEVTGGV

LADESADLLRGFFRARRKAKI

*Geobacter sulfurreducens* (*G. sulfurreducens*) TadA:

(SEQ ID NO: 457)
MSSLKKTPIRDDAYWMGKAIREAAKAAARDEVPIGAVIVRDGAVIGRGHNLREGSNDPSAHAEMI

AIRQAARRSANWRLTGATLYVTLEPCLMCMGAIILARLERVVFGCYDPKGGAAGSLYDLSADPRL

NHQVRLSPGVCQEECGTMLSDFFRDLRRRKKAKATPALFIDERKVPPEP

*Streptococcus pyogenes* (*S. pyogenes*) TadA (SEQ ID NO: 491)
MPYSLEEQTYFMQEALKEAEKSLQKAEIPIGCVIVKDGEIIGRGHNAREESNQAIMHAEIMAINEAN

AHEGNWRLLDTTLFVTIEPCVMCSGAIGLARIPHVIYGASNQKFGGADSLYQILTDERLNHRVQVE

RGLLAADCANIMQTFFRQGRERKKIAKHLIKEQSDPFD

TadA7.10:

(SEQ ID NO: 492)
SEVEFSHEYWMRHALTLAKRARDEREVPVGAVLVLNNRVIGEGWNRAIGLHDPTAHAEIMALRQ

GGLVMQNYRLIDATLYVTFEPCVMCAGAMIHSRIGRVVFGVRNAKTGAAGSLMDVLHYPGMNH

RVEITEGILADECAALLCYFFRMPRQVFNAQKKAQSSTD

-continued

TadA7.10 (V106W) (*E. coli*)

(SEQ ID NO: 493)

SEVEFSHEYWMRHALTLAKRARDEREVPVGAVLVLNNRVIGEGWNRAIGLHDPTAHAEIMALRQ

GGLVMQNYRLIDATLYVTFEPCVMCAGAMIHSRIGRVVFGWRNAKTGAAGSLMDVLHYPGMNH

RVEITEGILADECAALLCYFFRMPRQVFNAQKKAQSSTD

TadA-8e (*E. coli*)

(SEQ ID NO: 494)

SEVEFSHEYWMRHALTLAKRARDEREVPVGAVLVLNNRVIGEGWNRAIGLHDPTAHAEIMALRQ

GGLVMQNYRLIDATLYVTFEPCVMCAGAMIHSRIGRVVFGVRNSKRGAAGSLMNVLNYPGMNH

RVEITEGILADECAALLCDFYRMPRQVFNAQKKAQSSIN

TadA-8e (V106W) (*E. coli*)

(SEQ ID NO: 495)

SEVEFSHEYWMRHALTLAKRARDEREVPVGAVLVLNNRVIGEGWNRAIGLHDPTAHAEIMALRQ

GGLVMQNYRLIDATLYVTFEPCVMCAGAMIHSRIGRVVFGWRNSKRGAAGSLMNVLNYPGMNH

RVEITEGILADECAALLCDFYRMPRQVFNAQKKAQSSIN

In some embodiments, the adenosine deaminase domain comprises a *E. coli* TadA (SEQ ID NO: 314). Additional non-limiting examples of ecTadA deaminase mutants suitable for the adenine nucleobase editors of the disclosure are provided in Table 1. More specifically, the mutations in ecTadA and constructs expressing nucleobase editors comprising the modified ecTadA contemplated for use in the disclosed nucleobase editors are provided in Table 1.

TABLE 1

EcTadA mutants for A to G nucleobase editor

| Name | Construct Architecture | Mutations in TadA |
|---|---|---|
| pNMG-142 | pCMV_ecTadA_XTEN_Cas9n_SGGS_NLS | wild-type |
| pNMG-143 | pCMV_ecTadA_XTEN_Cas9n_SGGS_NLS | D108N |
| pNMG-144 | pCMV_ecTadA_XTEN_Cas9n_SGGS_NLS | A106V_D108N |
| pNMG-145 | pCMV_ecTadA_XTEN_Cas9n_SGGS_NLS | D108G |
| pNMG-146 | pCMV_ecTadA_XTEN_Cas9n_SGGS_NLS | R107C_D108N |
| pNMG-147 | pCMV_ecTadA_XTEN_Cas9n_SGGS_NLS | D108V |
| pNMG-155 | pCMV_ecTadA_XTEN_dead Cas9_SGGS_UGI_NLS | D108N |
| pNMG-156 | pCMV_ecTadA_XTEN_nCas9_SGGS_UGI_SGGS_NLS | D108N |
| pNMG-157 | pCMV_ecTadA_XTEN_deadCas9_SGGS_UGI_SGGS_NLS | D108G |
| pNMG-158 | pCMV_ecTadA_XTEN_nCas9_SGGS_UGI_SGGS_NLS | D108G |
| pNMG-160 | pCMV_ecTadA_XTEN_nCas9_SGGS_AAG*(E125Q)_SGGS_NLS | D108N |
| pNMG-161 | pCMV_ecTadA_XTEN_Cas9n_SGGS_EndoVID35ALNLS | D108N |
| pNMG-162 | pCMV_ecTadA_XTEN_Cas9n_SGGS_NLS | H8Y_D108N_S127S_D147Y_Q154H |
| pNMG-163 | pCMV_ecTadA_XTEN_Cas9n_SGGS_NLS | H8Y_R24W_D108N_N127S_D147Y_E155V |
| pNMG-164 | pCMV_ecTadA_XTEN_Cas9n_SGGS_NLS | D108N_D147Y_E155V |
| pNMG-165 | pCMV_ecTadA_XTEN_Cas9n_SGGS_NLS | H8Y_D108N_S127S |

TABLE 1-continued

EcTadA mutants for A to G nucleobase editor

| Name | Construct Architecture | Mutations in TadA |
|---|---|---|
| pNMG-171 | pCMV_Cas9n_XTEN_ecTadA_SGGS_NLS | wild-type |
| pNMG-172 | pCMV_Cas9n_XTEN_ecTadA_SGGS_NLS | D108N |
| pNMG-173 | pCMV_Cas9n_XTEN_ecTadA_SGGS_NLS | H8Y_D108N_N127S_D147Y_Q154H |
| pNMG-174 | pCMV_Cas9n_XTEN_ecTadA_SGGS_NLS | H8Y_R24W_D108N_N127S_D147Y_E155V |
| pNMG-175 | pCMV_Cas9n_XTEN_ecTadA_SGGS_NLS | D108N_D147Y_E155V |
| pNMG-176 | pCMV_Cas9n_XTEN_ecTadA_SGGS_NLS | H8Y_D108N_S127S |
| pNMG-177 | pCMV_ecTadA_XTEN_Cas9n_SGGS_NLS | A106V_D108N_D147Y_E155V |
| pNMG-178 | pCMV_ecTadA_XTEN_Cas9n_SGGS_UGI_SGGS_NLS | D108N_D147Y_E155V |
| pNMG-179 | pCMV_ecTadA_XTEN_Cas9n_SGGS_AAG*(E125Q)_SGGS_NLS | A106V_D108N_D147Y_E155V |
| pNMG-180 | pCMV_ecTadA_XTEN_Cas9n_SGGS_UGI_SGGS_NLS | A106V_D108N_D147Y_E155V |
| pNMG-181 | pCMV_ecTadA_XTEN_Cas9n_SGGS_AAG*(E125Q)_SGGS_NLS | D108N_D147Y_E155V |
| pNMG-182 | pCMV_ecTadA_SGGS_nCas9_SGGS_NLS | D108N_D147Y_E155V |
| pNMG-183 | pCMV_ecTadA_(SGGS)2-XTEN-(SGGS)2_nCas9_SGGS_NLS | D108N_D147Y_E155V |
| pNMG-235 | pCMV_ecTadA_XTEN_Cas9n_XTEN_AAG*(E125A)_SGGS_NLS | A106V_D108N_D147Y_E155V |
| pNMG-236 | pCMV_ecTadA_XTEN_Cas9n_XTEN_AAG*(E125Q)_SGGS_NLS | A106V_D108N_D147Y_E155V |
| pNMG-237 | pCMV_ecTadA_XTEN_Cas9n_XTEN_AAG*(wt)_SGGS_NLS | A106V_D108N_D147Y_E155V |
| pNMG-238 | pCMV_AAG*(E125A)_XTEN_ecTadA_XTEN_Cas9n_SGGS_NLS | A106V_D108N_D147Y_E155V |
| pNMG-239 | pCMV_AAG*(wt)_XTEN_ecTadA_XTEN_Cas9n_SGGS_NLS | A106V_D108N_D147Y_E155V |

TABLE 1-continued

EcTadA mutants for A to G nucleobase editor

| Name | Construct Architecture | Mutations in TadA |
| --- | --- | --- |
| pNMG-240 | pCMV_ecTadA_XTEN_ Cas9n_XTEN_ EndoV&(D35A)_SGGS_NLS | A106V_D108N_ D147Y_E155V |
| pNMG-241 | pCMV_ecTadA_XTEN_ Cas9n_XTEN_ EndoV*(wt)_SGGS_NLS | A106V_D108N_ D147Y_E155V |
| pNMG-242 | pCMV_EndoVID35A)_ XTEN_ecTadA_ XTEN_Cas9n_SGGS_NLS | A106V_D108N_ D147Y_E155V |
| pNMG-243 | pCMV_EndoV*(wt)_ XTEN_ecTadA_ XTEN_Cas9n_SGGS_NLS | A106V_D108N_ D147Y_E155V |
| pNMG-247 | pCMV_ecTadA_XTEN_Cas9 (wild-type)_SGGS_NLS | wild-type |
| pNMG-248 | pCMV_ecTadA_XTEN_Cas9 (wild-type)_SGGS_NLS | D108N_D147Y_ E155V |
| pNMG-249 | pCMV_ecTadA_XTEN_Cas9 (wild-type)_SGGS_NLS | A106V_D108N_ D147Y_E155V |
| pNMG-250 | pCMV_ecTadA_XTEN_ Cas9 (wild-type)_ SGGS_UGI_SGGS_NLS | D108N_D147Y_ E155V |
| pNMG-251 | pCMV_ecTadA_XTEN_ Cas9 (wild-type)_SGGS_ AAG*(E125Q)_SGGS_NLS | A106V_D108N_ D147Y_E155V |
| pNMG-274 | pCMV_ecTadA_SGGS_NLS (no Cas9 fusion) | wild-type |
| pNMG-275 | pCMV_ecTadA_SGGS_NLS (no Cas9 fusion) | A106V_D108N_ D147Y_E155V |
| pNMG-276 | pCMV_ecTadA-(SGGS)2- XTEN-(SGGS)2_ ecTadA_XTEN_nCas9_ SGGS_NLS | (wild-type) + (wild-type) |
| pNMG-277 | pCMV_ecTadA-(SGGS)2- XTEN-(SGGS)2_ ecTadA_XTEN_nCas9_ SGGS_NLS | (A106V_D108N_ D147Y_E155V) + (A106V_D108N_ D147Y_E155V) |
| pNMG-278 | pCMV_ecTadA_XTEN_ nCas9_SGGS_NLS | D108Q_D147Y_ E155V |
| pNMG-279 | pCMV_ecTadA_XTEN_ nCas9_SGGS_NLS | D108M_D147Y_ E155V |
| pNMG-280 | pCMV_ecTadA_XTEN_ nCas9_SGGS_NLS | D108L_D147Y_ E155V |
| pNMG-281 | pCMV_ecTadA_XTEN_ nCas9_SGGS_NLS | D108K_D147Y_ E155V |
| pNMG-282 | pCMV_ecTadA_XTEN_ nCas9_SGGS_NLS | D108I_D147Y_ E155V |
| pNMG-283 | pCMV_ecTadA_XTEN_ nCas9_SGGS_NLS | D108F_D147Y_ E155V |
| pNMG-284 | pCMV_ecTadA_LONGER LINKER (92 a.a.)_ ecTadA_XTEN_nCas9_ SGGS_NLS | (wild-type) + (A106V_D108N_ D147Y_E155V) |
| pNMG-285 | pCMV_ecTadA_LONGER LINKER (92 a.a.)_ ecTadA_XTEN_nCas9_ SGGS_NLS | (A106V_D108N_ D147Y_ E155V) + (A106V_ D108N_D147Y) |
| pNMG-285b | pCMV_ecTadA_LONGER LINKER (92 a.a.)_ ecTadA_XTEN_nCas9_ SGGS_NLS | (A106V_D108N_ D147Y_ E155V) + (A106V_ D108N_D147Y) |
| pNMG-286 | pCMV_ecTadA_XTEN_ nCas9_SGGS_NLS | A106V_D108M_ D147Y_E155V |
| pNMG-287 | pCMV_ecTadA-(SGGS)2- XTEN-(SGGS)2_ ecTadA_XTEN-nCas9 (*S. aureus*)_SGGS_NLS | (A106V_D108N_ D147Y_E155V) + (A106V_D108N_ D147Y_E155V) |
| pNMG-289 | pCMV_ecTadA-(SGGS)2- XTEN-(SGGS)2_ ecTadA_XTEN_nCas9_ SGGS_UGI_NLS | (A106V_D108N_ D147Y_E155V) + (A106V_D108N_ D147Y_E155V) |
| pNMG-290 | pCMV_ecTadA-(SGGS)2- XTEN-(SGGS)2_ecTadA_ (SGGS)2-XTEN-(SGGS)2_ nCas9_SGGS_UGI_NLS | (A106V_D108N_ D147Y_E155V) + (A106V_D108N_ D147Y_E155V) |
| pNMG-293 | pCMV_ecTadA_XTEN_ Cas9n_SGGS_NLS | E59A_A106V_ D108N_ D147Y_E155V |
| pNMG-294 | pCMV_ecTadA_XTEN_ Cas9n_SGGS_NLS | E59A |
| pNMG-295 | pCMV_ecTadA_SGGS_NLS (no Cas9 fusion) | E59A |
| pNMG-296 | pCMV_ecTadA_SGGS_NLS (no Cas9 fusion) | E59A cat dead_ A106V_D108N_ D147Y_E155V |
| pNMG-297 | pCMV_ecTadA-(SGGS)2- XTEN-(SGGS)2_ ecTadA_XTEN_nCas9_ SGGS_NLS | (A106V_D108N_ D147Y_E155V) + (wild-type) |
| pNMG-298 | pCMV_ecTadA-(SGGS)2- XTEN-(SGGS)2_ ecTadA_XTEN_nCas9_ SGGS_NLS | (D108M_D147Y_ E155V) + (D108M_ D147Y_E155V) |
| pNMG-320 | pCMV_ecTadA-(SGGS)2- XTEN-(SGGS)2_ ecTadA_XTEN_nCas9_ SGGS_NLS | (wild-type) + (A106V_ D108N_D147Y_ E155V) |
| pNMG-321 | pCMV_ecTadA-(SGGS)2- XTEN-(SGGS)2_ ecTadA_XTEN_nCas9_ SGGS_NLS | (E59A_A106V_ D108N_ D147Y_E155V) + (A106V_D108N_ D147Y_E155V) |
| pNMG-322 | pCMV_ecTadA-(SGGS)2- XTEN-(SGGS)2_ ecTadA_XTEN_nCas9_ SGGS_NLS | (A106V_D108N_ D147Y_ E155V) + (E59A_ A106V_D108N_ D147Y_E155V) |
| pNMG-335 | pCMV_TadA3p-XTEN- TadA2p-XTEN-nCas9-NLS | wild-type |
| pNMG-336 | pCMV_ecTadA_(SGGS)2- XTEN-(SGGS)2_ nCas9_SGGS_UGI_ SGGS_NLS | L84F_A106V_ D108N_H123Y_ D147Y_E155V_ I156Y |
| pNMG-337 | pCMV_ecTadA_(SGGS)2- XTEN-(SGGS)2_ nCas9_SGGS_UGI_ SGGS_NLS | A106V_D108N_ D147Y_E155V |
| pNMG-338 | pCMV_ecTadA_(SGGS)2- XTEN-(SGGS)2_ nCas9_SGGS_UGI_ SGGS_NLS | L84F_A106V_ D108N_H123Y_ D147Y_E155V_ I156F |
| pNMG-339 | pCMV_ecTadA-(SGGS)2- XTEN-(SGGS)2_ ecTadA_(SGGS)2- XTEN-(SGGS)2_nCas9_ SGGS_UGI_SGGS_NLS | (L84F_A106V_ D108N_ H123Y_D147Y_ E155V_I156Y) + (L84F_A106V_ D108N_ H123Y_D147Y_ E155V_I156Y) |
| pNMG-340 | pCMV_ecTadA-(SGGS) 2-XTEN-(SGGS)2_ecTadA_ (SGGS)2-XTEN-(SGGS)2_ nCas9_SGGS_UGI_ SGGS_NLS | (A106V_D108N_ D147Y_E155V) + (A106V_D108N_ D147Y_E155V) |
| pNMG-341 | pCMV_ecTadA-(SGGS)2- XTEN-(SGGS)2_ ecTadA_(SGGS)2-XTEN- (SGGS)2_nCas9_SGGS_ UGI_SGGS_NLS | (L84F_A106V_ D108N_ H123Y_D147Y_ E155V_I156F) + (L84F_A106V_ D108N_ H123Y_D147Y_ E155V_I156F) |
| pNMG-345 | pCMV_*S. aureus*TadA- (SGGS)2-XTEN-(SGGS)2- *S.aureus*TadA-(SGGS)2- XTEN-(SGGS)2-nCas9_S SGGS_NL | wild-type |

TABLE 1-continued

EcTadA mutants for A to G nucleobase editor

| Name | Construct Architecture | Mutations in TadA |
|---|---|---|
| pNMG-346 | pCMV_*S. aureus*TadA-(SGGS)2-XTEN-(SGGS)2-*S.aureus*TadA-(SGGS)2-XTEN-(SGGS)2-nCas9_SGGS_NLS | (D108N) + (D108N) |
| pNMG-347 | pCMV_*S. aureus*TadA-(SGGS)2-XTEN-(SGGS)2-*S.aureus*TadA-(SGGS)2-XTEN-(SGGS)2-nCas9_SGGS_NLS | (D107A_D018N) + (D107A_D108N) |
| pNMG-348 | pCMV_*S. aureus*TadA-(SGGS)2-XTEN-(SGGS)2-*S.aureus*TadA-(SGGS)2-XTEN-(SGGS)2-nCas9_SGGS_NLS | (G26P_D107A_D108N) + (G26P_D107A_D108N) |
| pNMG-349 | pCMV_*S. aureus*TadA-(SGGS)2-XTEN-(SGGS)2-*S.aureus*TadA-(SGGS)2-XTEN-(SGGS)2-nCas9_SGGS_NLS | (G26P_D107A_D108N_S142A) + (G26P_D107A_D108N_S142A) |
| pNMG-350 | pCMV_*S. aureus*TadA-(SGGS)2-XTEN-(SGGS)2-*S.aureus*TadA-(SGGS)2-XTEN-(SGGS)2-nCas9_SGGS_NLS | (D104A_D108N_S142A) + (D107A_D108N_S142A) |
| pNMG-351 | pCMV_ecTadA_(SGGS)2-XTEN-(SGGS)2_nCas9_SGGS_NLS | (R26G_L84F_A106V_R107H_D108N_H123Y_A142N_A143D_D147Y_E155V_I156F) |
| pNMG-352 | pCMV_ecTadA_(SGGS)2-XTEN-(SGGS)2_nCas9_SGGS_NLS | (E25G_R26G_L84F_A106V_R107H_D108N_H123Y_A142N_A143D_D147Y_E155V_I156F) |
| pNMG-353 | pCMV_ecTadA_(SGGS)2-XTEN-(SGGS)2_nCas9_SGGS_NLS | (E25D_R26G_L84F_A106V_R107K_D108N_H123Y_A142N_A143G_D147Y_E155V_I156F) |
| pNMG-354 | pCMV_ecTadA_(SGGS)2-XTEN-(SGGS)2_nCas9_SGGS_NLS | (R26Q_L84F_A106V_D108N_H123Y_A142N_D147Y_E155V_I156F) |
| pNMG-355 | pCMV_ecTadA_(SGGS)2-XTEN-(SGGS)2_nCas9_SGGS_NLS | (E25M_R26G_L84F_A106V_R107P_D108N_H123Y_A142N_A143D_D147Y_E155V_I156F) |
| pNMG-356 | pCMV_ecTadA_(SGGS)2-XTEN-(SGGS)2_nCas9_SGGS_NLS | (R26C_L84F_A106V_R107H_D108N_H123Y_A142N_D147Y_E155V_I156F) |
| pNMG-357 | pCMV_ecTadA_(SGGS)2-XTEN-(SGGS)2_nCas9_SGGS_NLS | (L84F_A106V_D108N_H123Y_A142N_A143L_D147Y_E155V_I156F) |
| pNMG-358 | pCMV_ecTadA_(SGGS)2-XTEN-(SGGS)2_nCas9_SGGS_NLS | (R26G_L84F_A106V_D108N_H123Y_A142N_D147Y_E155V_I156F) |
| pNMG-359 | pCMV_ecTadA_(SGGS)2-XTEN-(SGGS)2_nCas9_SGGS_NLS | (E25A_R26G_L84F_A106V_R107N_D108N_H123Y_A142N_A143E_D147Y_E155V_I156F) |

TABLE 1-continued

EcTadA mutants for A to G nucleobase editor

| Name | Construct Architecture | Mutations in TadA |
|---|---|---|
| pNMG-360 | pCMV_ecTadA-(SGGS)2-XTEN-(SGGS)2-ecTadA-(SGGS)2-XTEN-(SGGS)2_nCas9_SGGS_NLS | (R26G_L84F_A106V_R107H_D108N_H123Y_A142N_A143D_D147Y_E155V_I156F) + (R26G_L84F_A106V_R107H_D108N_H123Y_A142N_A143D_D147Y_E155V_I156F) |
| pNMG-361 | pCMV_ecTadA-(SGGS)2-XTEN-(SGGS)2-ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) X 2 |
| pNMG-362 | pCMV_ecTadA-(SGGS)2-XTEN-(SGGS)2-ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) X 2 |
| pNMG-363 | pCMV_ecTadA-(SGGS)2-XTEN-(SGGS)2-ecTadA-(SGGS)2-XTEN-(SGGS)2_nCas9_SGGS_NLS | (R26Q_L84F_A106V_D108N_H123Y_A142N_D147Y_E155V_I156F) X 2 |
| pNMG-364 | pCMV_ecTadA-(SGGS)2-XTEN-(SGGS)2-ecTadA-(SGGS)2-XTEN-(SGGS)2_nCas9_SGGS_NLS | (E25M_R26G_L84F_A106V_R107P_D108N_H123Y_A142N_A143D_D147Y_E155V_I156F) X 2 |
| pNMG-365 | pCMV_ecTadA-(SGGS)2-XTEN-(SGGS)2-ecTadA-(SGGS)2-XTEN-(SGGS)2_nCas9_SGGS_NLS | (R26C_L84F_A106V_R107H_D108N_H123Y_A142N_D147Y_E155V_I156F) X 2 |
| pNMG-366 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_A143L_D147Y_E155V_I156F) X 2 |
| pNMG-367 | pCMV_ecTadA-(SGGS)2-XTEN-(SGGS)2-ecTadA-(SGGS)2-XTEN-(SGGS)2_nCas9_SGGS_NLS | (R26G_L84F_A106V_D108N_H123Y_A142N_D147Y_E155V_I156F) X 2 |
| pNMG-368 | pCMV_ecTadA-(SGGS)2-XTEN-(SGGS)2-ecTadA-(SGGS)2-XTEN-(SGGS)2_nCas9_SGGS_NLS | (E25A_R26G_L84F_A106V_R107N_D108N_H123Y_A142N_A143E_D147Y_E155V_I156F) X 2 |
| pNMG-369 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156Y) + (L84F_A106V_D108N_H123Y_D147Y_E155V_I156Y) |
| pNMG-370 | pCMV_ecTadA-(SGGS)2-XTEN-(SGGS)2-ecTadA-(SGGS)2-XTEN-(SGGS)2_nCas9_SGGS_NLS | (A106V_D108N_D147Y_E155V) + (A106V_D108N_D147Y_E155V) |

TABLE 1-continued

| EcTadA mutants for A to G nucleobase editor | | |
|---|---|---|
| Name | Construct Architecture | Mutations in TadA |
| pNMG-371 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (L84F_A106V_D108N_H123Y_D147Y_E155V_I156F) |
| pNMG-372 | pCMV_ecTadA_(SGGS)2-XTEN-(SGGS)2_Cas9n_SGGS_NLS | A106V_D108N_A142N_D147Y_E155V |
| pNMG-373 | pCMV_ecTadA_(SGGS)2-XTEN-(SGGS)2_Cas9n_SGGS_NLS | R26G_A106V_D108N_A142N_D147Y_E155V |
| pNMG-374 | pCMV_ecTadA_(SGGS)2-XTEN-(SGGS)2_Cas9n_SGGS_NLS | E25D_R26G_A106V_R107K_D108N_A142N_A143G_D147Y_E155V |
| pNMG-375 | pCMV_ecTadA_(SGGS)2-XTEN-(SGGS)2_Cas9n_SGGS_NLS | R26G_A106V_D108N_R107H_A142N_A143D_D147Y_E155V |
| pNMG-376 | pCMV_ecTadA_(SGGS)2-XTEN-(SGGS)2_Cas9n_SGGS_NLS | E25D_R26G_A106V_D108N_A142N_D147Y_E155V |
| pNMG-377 | pCMV_ecTadA_(SGGS)2-XTEN-(SGGS)2_Cas9n_SGGS_NLS | A106V_R107K_D108N_A142N_D147Y_E155V |
| pNMG-378 | pCMV_ecTadA_(SGGS)2-XTEN-(SGGS)2_Cas9n_SGGS_NLS | A106V_D108N_A142N_A143G_D147Y_E155V |
| pNMG-379 | pCMV_ecTadA_(SGGS)2-XTEN-(SGGS)2_Cas9n_SGGS_NLS | A106V_D108N_A142N_A143L_D147Y_E155V |
| pNMG-382 | pCMV_ecTadA-(SGGS)2-XTEN-(SGGS)2-ecTadA-(SGGS)2-XTEN-(SGGS)2_nCas9_SGGS_NLS | A106V_D108N_A142N_D147Y_E155V X 2 |
| pNMG-383 | pCMV_ecTadA-(SGGS)2-XTEN-(SGGS)2-ecTadA-(SGGS)2-XTEN-(SGGS)2_nCas9_SGGS_NLS | R26G_A106V_D108N_A142N_D147Y_E155V X 2 |
| pNMG-384 | pCMV_ecTadA-(SGGS)2-XTEN-(SGGS)2-ecTadA-(SGGS)2-XTEN-(SGGS)2_nCas9_SGGS_NLS | E25D_R26G_A106V_R107K_D108N_A142N_A143G_D147Y_E155V X 2 |
| pNMG-385 | pCMV_ecTadA-(SGGS)2-XTEN-(SGGS)2-ecTadA-(SGGS)2-XTEN-(SGGS)2_nCas9_SGGS_NLS | R26G_A106V_D108N_R107H_A142N_A143D_D147Y_E155V X 2 |
| pNMG-386 | pCMV_ecTadA-(SGGS)2-XTEN-(SGGS)2-ecTadA-(SGGS)2-XTEN-(SGGS)2_nCas9_SGGS_NLS | E25D_R26G_A106V_D108N_A142N_D147Y_E155V X 2 |
| pNMG-387 | pCMV_ecTadA-(SGGS)2-XTEN-(SGGS)2-ecTadA-(SGGS)2-XTEN-(SGGS)2_nCas9_SGGS_NLS | A106V_R107K_D108N_A142N_D147Y_E155V X 2 |
| pNMG-388 | pCMV_ecTadA-(SGGS)2-XTEN-(SGGS)2-ecTadA-(SGGS)2-XTEN-(SGGS)2_nCas9_SGGS_NLS | A106V_D108N_A142N_A143G_D147Y_E155V X 2 |
| pNMG-389 | pCMV_ecTadA-(SGGS)2-XTEN-(SGGS)2-ecTadA-(SGGS)2-XTEN-(SGGS)2_nCas9_SGGS_NLS | A106V_D108N_A142N_A143L_D147Y_E155V X 2 |

TABLE 1-continued

| EcTadA mutants for A to G nucleobase editor | | |
|---|---|---|
| Name | Construct Architecture | Mutations in TadA |
| pNMG-391 | pCMV_ecTadA_(SGGS)2-XTEN-(SGGS)2_Cas9n_SGGS_UGI_SGGS_NLS | H36L_R51L_L84F_A106V_D108N_H123Y_S146C_D147Y_E155V_I156F_K157N |
| pNMG-392 | pCMV_ecTadA_(SGGS)2-XTEN-(SGGS)2_Cas9n_SGGS_UGI_SGGS_NLS | N37T_P48T_M70L_L84F_A106V_D108N_H123Y_D147Y_149V_E155V_I156F |
| pNMG-393 | pCMV_ecTadA_(SGGS)2-XTEN-(SGGS)2_Cas9n_SGGS_UGI_SGGS_NLS | N37S_L84F_A106V_D108N_H123Y_D147Y_E155V_I156F_K161T |
| pNMG-394 | pCMV_ecTadA_(SGGS)2-XTEN-(SGGS)2_Cas9n_SGGS_UGI_SGGS_NLS | H36L_L84F_A106V_D108N_H123Y_D147Y_Q154H_E155V_I156F |
| pNMG-395 | pCMV_ecTadA_(SGGS)2-XTEN-(SGGS)2_Cas9n_SGGS_UGI_SGGS_NLS | N72S_L84F_A106V_D108N_H123Y_S146R_D147Y_E155V_I156F |
| pNMG-396 | pCMV_ecTadA_(SGGS)2-XTEN-(SGGS)2_Cas9n_SGGS_UGI_SGGS_NLS | H36L_P48L_L84F_A106V_D108N_H123Y_E134G_D147Y_E155V_I156F |
| pNMG-397 | pCMV_ecTadA_(SGGS)2-XTEN-(SGGS)2_Cas9n_SGGS_UGI_SGGS_NLS | H36L_L84F_A106V_D108N_H123Y_D147Y_E155V_I156F_K157N |
| pNMG-398 | pCMV_ecTadA_(SGGS)2-XTEN-(SGGS)2_Cas9n_SGGS_UGI_SGGS_NLS | H36L_L84F_A106V_D108N_H123Y_S146C_D147Y_E155V_I156F |
| pNMG-399 | pCMV_ecTadA_(SGGS)2-XTEN-(SGGS)2_Cas9n_SGGS_UGI_SGGS_NLS | L84F_A106V_D108N_H123Y_S146R_D147Y_E155V_I156F_K161T |
| pNMG-400 | pCMV_ecTadA_(SGGS)2-XTEN-(SGGS)2_Cas9n_SGGS_UGI_SGGS_NLS | N37S_R51H_D77G_L84F_A106V_D108N_H123Y_D147Y_E155V_I156F |
| pNMG-401 | pCMV_ecTadA_(SGGS)2-XTEN-(SGGS)2_Cas9n_SGGS_UGI_SGGS_NLS | R51L_L84F_A106V_D108N_H123Y_D147Y_E155V_I156F_K157N |
| pNMG-402 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) x 2 |
| pNMG-403 | pCMV_ecTadA-(SGGS)2-XTEN-(SGGS)2-ecTadA-(SGGS)2-XTEN-(SGGS)2_nCas9_SGGS_NLS | (N37T_P48T_M70L_L84F_A106V_D108N_H123Y_D147Y_I49V_E155V_I156F) x 2 |
| pNMG-404 | pCMV_ecTadA-(SGGS)2-XTEN-(SGGS)2-ecTadA-(SGGS)2-XTEN-(SGGS)2_nCas9_SGGS_NLS | (N37S_L84F_A106V_D108N_H123Y_D147Y_E155V_I156F_K161T) x 2 |
| pNMG-405 | pCMV_ecTadA-(SGGS)2-XTEN-(SGGS)2-ecTadA-(SGGS)2-XTEN- | (H36L_L84F_A106V_D108N_H123Y_D147Y_ |

TABLE 1-continued

EcTadA mutants for A to G nucleobase editor

| Name | Construct Architecture | Mutations in TadA |
|---|---|---|
| | (SGGS)2_nCas9_ SGGS_NLS | Q154H_E155V_ I156F) x 2 |
| pNMG-406 | pCMV_ecTadA-(SGGS)2-XTEN-(SGGS)2-ecTadA-(SGGS)2-XTEN-(SGGS)2_nCas9_ SGGS_NLS | (N72S_L84F_ A106V_D108N_ H123Y_S146R_ D147Y_E155V_ I156F) x 2 |
| pNMG-407 | pCMV_ecTadA-(SGGS)2-XTEN-(SGGS)2-ecTadA-(SGGS)2-XTEN-(SGGS)2_nCas9_ SGGS_NLS | (H36L_P48L_L84F_ A106V_D108N_ H123Y_E134G_ D147Y_E155V_ I156F) x 2 |
| pNMG-408 | pCMV_ecTadA-(SGGS)2-XTEN-(SGGS)2-ecTadA-(SGGS)2-XTEN-(SGGS)2_nCas9_ SGGS_NLS | (H36L_L84F_ A106V_D108N_ H123Y_D147Y_ E155V_I156F_ K157N) x 2 |
| pNMG-409 | pCMV_ecTadA-(SGGS)2-XTEN-(SGGS)2-ecTadA-(SGGS)2-XTEN-(SGGS)2_nCas9_ SGGS_NLS | (H36L_L84F_ A106V_D108N_ H123Y_S146C_ D147Y_E155V_ I156F) x 2 |
| pNMG-410 | pCMV_ecTadA-(SGGS)2-XTEN-(SGGS)2-ecTadA-(SGGS)2-XTEN-(SGGS)2_nCas9_ SGGS_NLS | (L84F_A106V_ D108N_H123Y_ S146R_D147Y_ E155V_I156F_ K161T) x 2 |
| pNMG-411 | pCMV_ecTadA-(SGGS)2-XTEN-(SGGS)2-ecTadA-(SGGS)2-XTEN-(SGGS)2_nCas9_ SGGS_NLS | (N37S_R51H_D77G_ L84F_A106V_ D108N_H123Y_ D147Y_E155V_ I156F) x 2 |
| pNMG-412 | pCMV_ecTadA-(SGGS)2-XTEN-(SGGS)2-ecTadA-(SGGS)2-XTEN-(SGGS)2_nCas9_ SGGS_NLS | (R51L_L84F_ A106V_D108N_ H123Y_D147Y_ E155V_I156F_ K157N) x 2 |
| pNMG-440 | pCMV_ecTadA_ (SGGS)2-XTEN-(SGGS)2_Cas9n_SGGS_ UGI_SGGS_NLS | D24G_Q71R_ L84F_H96L_ A106V_D108N_ H123Y_D147Y_ E155V_I156F_K160E |
| pNMG-441 | pCMV_ecTadA_ (SGGS)2-XTEN-(SGGS)2_Cas9n_SGGS_ UGI_SGGS_NLS | H36L_G67V_ L84F_A106V_ D108N_H123Y_ S146T_D147Y_ E155V_I156F |
| pNMG-442 | pCMV_ecTadA_ (SGGS)2-XTEN-(SGGS)2_Cas9n_SGGS_ UGI_SGGS_NLS | Q71L_L84F_ A106V_D108N_ H123Y_L137M_ A143E_D147Y_ E155V_I156F |
| pNMG-443 | pCMV_ecTadA_ (SGGS)2-XTEN-(SGGS)2_Cas9n_SGGS_ UGI_SGGS_NLS | E25G_L84F_ A106V_ D108N_H123Y_ D147Y_E155V_ I156F_Q159L |
| pNMG-444 | pCMV_ecTadA_ (SGGS)2-XTEN-(SGGS)2_Cas9n_SGGS_ UGI_SGGS_NLS | L84F_A91T_ F104I_ A106V_D108N_ H123Y_D147Y_ E155V_I156F |
| pNMG-445 | pCMV_ecTadA_ (SGGS)2-XTEN-(SGGS)2_Cas9n_SGGS_ UGI_SGGS_NLS | N72D_L84F_ A106V_ D108N_H123Y_ G125A_D147Y_ E155V_I156F |
| pNMG-446 | pCMV_ecTadA_ (SGGS)2-XTEN-(SGGS)2_Cas9n_SGGS_ UGI_SGGS_NLS | P48S_L84F_ S97C_ A106V_D108N_ H123Y_D147Y_ E155V_I156F |
| pNMG-447 | pCMV_ecTadA_ (SGGS)2-XTEN-(SGGS)2_Cas9n_SGGS_ UGI_SGGS_NLS | W23G_L84F_ A106V_D108N_ H123Y_D147Y_ E155V_I156F |
| pNMG-448 | pCMV_ecTadA_ (SGGS)2-XTEN-(SGGS)2_Cas9n_SGGS_ UGI_SGGS_NLS | D24G_P48L_Q71R_ L84F_A106V_ D108N_H123Y_ D147Y_E155V_ I156F_Q159L |
| pNMG-449 | pCMV_ecTadA-(SGGS)2-XTEN-(SGGS)2-ecTadA-(SGGS)2-XTEN-(SGGS)2_nCas9_ SGGS_NLS | (D24G_Q71R_ L84F_H96L_ A106V_D108N_ H123Y_D147Y_ E155V_I156F_ K160E) x 2 |
| pNMG-450 | pCMV_ecTadA-(SGGS)2-XTEN-(SGGS)2-ecTadA-(SGGS)2-XTEN-(SGGS)2_nCas9_ SGGS_NLS | (H36L_G67V_ L84F_ A106V_D108N_ H123Y_S146T_ D147Y_E155V_ I156F) x 2 |
| pNMG-451 | pCMV_ecTadA-(SGGS)2-XTEN-(SGGS)2-ecTadA-(SGGS)2-XTEN-(SGGS)2_nCas9_ SGGS_NLS | (Q71L_L84F_ A106V_ D108N_H123Y_ L137M_A143E_ D147Y_E155V_ I156F) x 2 |
| pNMG-452 | pCMV_ecTadA-(SGGS)2-XTEN-(SGGS)2-ecTadA-(SGGS)2-XTEN-(SGGS)2_nCas9_ SGGS_NLS | (E25G_L84F_ A106V_D108N_ H123Y_D147Y_ E155V_I156F_ Q159L) x 2 |
| pNMG-453 | pCMV_ecTadA-(SGGS)2-XTEN-(SGGS)2-ecTadA-(SGGS)2-XTEN-(SGGS)2_nCas9_ SGGS_NLS | (L84F_A91T_ F1041_A106V_ D108N_H123Y_ D147Y_E155V_ I156F) x 2 |
| pNMG-454 | pCMV_ecTadA-(SGGS)2-XTEN-(SGGS)2-ecTadA-(SGGS)2-XTEN-(SGGS)2_nCas9_ SGGS_NLS | (N72D_L84F_ A106V_D108N_ H123Y_G125A_ D147Y_E155V_ I156F) x 2 |
| pNMG-455 | pCMV_ecTadA-(SGGS)2-XTEN-(SGGS)2-ecTadA-(SGGS)2-XTEN-(SGGS)2_nCas9_ SGGS_NLS | (P48S_L84F_ S97C_A106V_ D108N_H123Y_ D147Y_E155V_ I156F) x 2 |
| pNMG-456 | pCMV_ecTadA-(SGGS)2-XTEN-(SGGS)2-ecTadA-(SGGS)2-XTEN-(SGGS)2_nCas9_ SGGS_NLS | (W23G_L84F_ A106V_ D108N_H123Y_ D147Y_E155V_ I156F) x 2 |
| pNMG-457 | pCMV_ecTadA-(SGGS)2-XTEN-(SGGS)2-ecTadA-(SGGS)2-XTEN-(SGGS)2_nCas9_ SGGS_NLS | (D24G_P48L_ Q71R_L84F_ A106V_D108N_ H123Y_D147Y_ E155V_I156F_ Q159L) x 2 |
| pNMG-473 | pCMV_ecTadA_(SGGS)2-XTEN-(SGGS)2_ Cas9n_SGGS_ UGI_SGGS_NLS | L84F_A106V_ D108N_H123Y_ A142N_D147Y_ E155V_I156F |
| pNMG-474 | pCMV_ecTadA-(SGGS)2-XTEN-(SGGS)2-ecTadA-(SGGS)2-XTEN-(SGGS)2_nCas9_ SGGS_NLS | L84F_A106V_ D108N_H123Y_ A142N_D147Y_ E155V_ I156F x 2 |
| pNMG-475 | pCMV_ecTadA-(SGGS)2-XTEN-(SGGS)2-ecTadA-(SGGS)2-XTEN-(SGGS)2_nCas9_ SGGS_NLS | (wild-type) + (A106V_D108N_ D147Y_E155V) |

TABLE 1-continued

EcTadA mutants for A to G nucleobase editor

| Name | Construct Architecture | Mutations in TadA |
|---|---|---|
| pNMG-476 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_D147Y_E155V_I156F) |
| pNMG-477 | pCMV_ecTadA-(SGGS)2-XTEN-(SGGS)2-ecTadA-(SGGS)2-XTEN-(SGGS)2_nCas9_SGGS_NLS | (wild-type) + (H36L_R51L_L84F_A106V_D108N_H123Y_S146C_D147Y_E155V_I156F_K157N) |
| pNMG-478 | pCMV_ecTadA-(SGGS)2-XTEN-(SGGS)2-ecTadA-(SGGS)2-XTEN-(SGGS)2_nCas9_SGGS_NLS | (wild-type) + (N37S_L84F_A106V_D108N_H123Y_D147Y_E155V_I156F_K161T) |
| pNMG-479 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_S146R_D147Y_E155V_I156F_K161T) |
| pNMG-480 | pCMV_ecTadA_(SGGS)2-XTEN-(SGGS)2_Cas9n_SGGS_NLS | wild-type |
| pNMG-481 | pCMV_ecTadA_(SGGS)2-XTEN-(SGGS)2_Cas9n_SGGS_NLS | A106V_D108N |
| pNMG-482 | pCMV_ecTadA-(SGGS)2-XTEN-(SGGS)2-ecTadA-(SGGS)2-XTEN-(SGGS)2_nCas9_SGGS_NLS | wild-type + wild-type |
| pNMG-483 | pCMV_ecTadA-(SGGS)2-XTEN-(SGGS)2-ecTadA-(SGGS)2-XTEN-(SGGS)2_nCas9_SGGS_NLS | (A106V_D108N) x 2 |
| pNMG-484 | pCMV_ecTadA-(SGGS)2-XTEN-(SGGS)2-ecTadA-(SGGS)2-XTEN-(SGGS)2_nCas9_SGGS_NLS | (wild-type) + (A106V_D108N) |
| pNMG-485 | pCMV_ecTadA_(SGGS)2-XTEN-(SGGS)2_Cas9n_SGGS_UGI_SGGS_NLS | H36L_R51L_L84F_A106V_D108N_H123Y_A142N_S146C_D147Y_E155V_I156F_K157N |
| pNMG-486 | pCMV_ecTadA_(SGGS)2-XTEN-(SGGS)2_Cas9n_SGGS_UGI_SGGS_NLS | N37S_L84F_A106V_D108N_H123Y_A142N_D147Y_E155V_I156F_K161T |
| pNMG-487 | pCMV_ecTadA_(SGGS)2-XTEN-(SGGS)2_Cas9n_SGGS_UGI_SGGS_NLS | L84F_A106V_D108N_D147Y_E155V_I156F |
| pNMG-488 | pCMV_ecTadA_(SGGS)2-XTEN-(SGGS)2_Cas9n_SGGS_UGI_SGGS_NLS | R51L_L84F_A106V_D108N_H123Y_S146C_D147Y_E155V_I156F_K157N_K161T |
| pNMG-489 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K161T |
| pNMG-490 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K157N_K160E_K161T |
| pNMG-491 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K157N_K160E |
| pNMG-492 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_A142N_D147Y_E155V_I156F) |
| pNMG-493 | pCMV_ecTadA-(SGGS)2-XTEN-(SGGS)2-ecTadA-(SGGS)2-XTEN-(SGGS)2_nCas9_SGGS_NLS | (wt) + (D24G_Q71R_L84F_H96L_A106V_D108N_H123Y_D147Y_E155V_I156F_K160E) |
| pNMG-494 | pCMV_ecTadA-(SGGS)2-XTEN-(SGGS)2-ecTadA-(SGGS)2-XTEN-(SGGS)2_nCas9_SGGS_NLS | (wt) + (H36L_R51L_L84F_A106V_D108N_H123Y_A142N_S146C_D147Y_E155V_I156F_K157N) |
| pNMG-495 | pCMV_ecTadA-(SGGS)2-XTEN-(SGGS)2-ecTadA-(SGGS)2-XTEN-(SGGS)2_nCas9_SGGS_NLS | (wt) + (N37S_L84F_A106V_D108N_H123Y_A142N_D147Y_E155V_I156F_K161T) |
| pNMG-496 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_D147Y_E155V_I156F) |
| pNMG-497 | pCMV_ecTadA-(SGGS)2-XTEN-(SGGS)2-ecTadA-(SGGS)2-XTEN-(SGGS)2_nCas9_SGGS_NLS | (wt) + (R51L_L84F_A106V_D108N_H123Y_S146C_D147Y_E155V_I156F_K157N_K161T) |
| pNMG-498 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K161T) |
| pNMG-499 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E_K161T) |
| pNMG-500 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E) |
| pNMG-513 | pCMV_ecTadA-92 a.a.-ecTadA-32a.a._nCas9_SGGS_NLS | (wt) + (L84F_A106V_D108N_H123Y_D147Y_E155V_I156F) |
| pNMG-514 | pCMV_ecTadA-92 a.a.-ecTadA-32a.a._nCas9_SGGS_NLS | (L84F_A106V_D108N_H123Y_D147Y_E155V_I156F) + (L84F_A106V_D108N_H123Y_D147Y_E155V_I156F) |
| pNMG-515 | pCMV_ecTadA-92 a.a.-ecTadA-32a.a._nCas9_SGGS_NLS | (wt) + (L84F_A106V_D108N_H123Y_D147Y_E155V_I156F) |
| pNMG-516 | pCMV_ecTadA-92 a.a.-ecTadA-32a.a._nCas9_SGGS_NLS | (L84F_A106V_D108N_H123Y_D147Y_E155V_I156F) + (L84F_A106V_D108N_H123Y_D147Y_E155V_I156F) |
| pNMG-517 | pCMV_ecTadA-92 a.a.-ecTadA-32a.a._nCas9_SGGS_NLS | (wt) + (L84F_A106V_D108N_H123Y_D147Y_E155V_I156F) |

TABLE 1-continued

EcTadA mutants for A to G nucleobase editor

| Name | Construct Architecture | Mutations in TadA |
|---|---|---|
| pNMG-518 | pCMV_ecTadA-92 a.a.-ecTadA-32a.a._ nCas9_SGGS_NLS | (L84F_A106V_D108N_ H123Y_D147Y_E155V_ I156F) + (L84F_A106V_ D108N_H123Y_D147Y_ E155V_I156F) |
| pNMG-519 | pCMV_ecTadA- 32 a.a.-_ nCas9_SGGS_NLS | R74Q |
| pNMG-520 | pCMV_ecTadA- 32 a.a.-_ nCas9_SGGS_NLS | R74Q L84F_A106V_D108N_ H123Y_D147Y_E155V_ I156F |
| pNMG-521 | pCMV_ecTadA- 32 a.a.-_ nCas9_SGGS_NLS | R74A_L84F_A106V_ D108N_H123Y_ D147Y_E155V_I156F |
| pNMG-522 | pCMV_ecTadA- 32 a.a.-_ nCas9_SGGS_NLS | R98Q |
| pNMG-523 | pCMV_ecTadA- 32 a.a.-_ nCas9_SGGS_NLS | R129Q |
| pNMG-524 | pCMV_ecTadA-(SGGS)2- XTEN-(SGGS)2- ecTadA-(SGGS)2-XTEN- (SGGS)2_nCas9_ SGGS_NLS | (wt + R74Q) + (L84F_A106V_ D108N_H123Y_D147Y_ E155V_I156F) |
| pNMG-525 | pCMV_ecTadA-(SGGS)2- XTEN-(SGGS)2- ecTadA-(SGGS)2-XTEN- (SGGS)2_nCas9_ SGGS_NLS | (wt + R74Q) + (R74Q_L84F_A106V_ D108N_H123Y_D147Y_ E155V_I156F) |
| pNMG-526 | pCMV_ecTadA-(SGGS)2- XTEN-(SGGS)2- ecTadA-(SGGS)2-XTEN- (SGGS)2_nCas9_ SGGS_NLS | (R74A_L84F_A106V_ D108N_H123Y_D147Y_ E155V_I156F) + (R74A_L84F_A106V_ D108N_H123Y_D147Y_ E155V_I156F) |
| pNMG-527 | pCMV_ecTadA-(SGGS)2- XTEN-(SGGS)2- ecTadA-(SGGS)2-XTEN- (SGGS)2_nCas9_ SGGS_NLS | (wt + R98Q) + (L84F_R98Q_A106V_ D108N_H123Y_D147Y_ E155V_I156F) |
| pNMG-528 | pCMV_ecTadA-(SGGS)2- XTEN-(SGGS)2- ecTadA-(SGGS)2-XTEN- (SGGS)2_nCas9_ SGGS_NLS | (wt + R129Q) + (L84F_A106V_D108N_ H123Y_R129Q_D147Y_ E155V_I156F) |
| pNMG-529 | pCMV_ecTadA-(SGGS)2- XTEN-(SGGS)2- ecTadA-(SGGS)2-XTEN- (SGGS)2_nCas9_ SGGS_NLS | (L84F_A106V_D108N_ H123Y_D147Y_E155V_ I156F) + (H36L_ R51L_L84F_A106V_ D108N_H123Y_ S146C_D147Y_ E155V_I156F_K157N) |
| pNMG-530 | pCMV_ecTadA-(SGGS)2- XTEN-(SGGS)2- ecTadA-(SGGS)2-XTEN- (SGGS)2_nCas9_ SGGS_NLS | (H36L_R51L_L84F_ A106V_D108N_H123Y_ S146C_D147Y_ E155V_I156F_K157N) + (L84F_A106V_D108N_ H123Y_D147Y_E155V_ I156F) |
| pNMG-543 | pCMV_ecTadA- (SGGS)2-XTEN- (SGGS)2_nCas9_ SGGS_NLS | (P48S_L84F_A106V_ D108N_H123Y_ A142N_D147Y_ E155V_I156F) |
| pNMG-544 | pCMV_ecTadA- (SGGS)2-XTEN- (SGGS)2_nCas9_ SGGS_NLS | (P48T_I49V_L84F_ A106V_D108N_H123Y_ A142N_D147Y_ E155V_I156F_L157N) |
| pNMG-545 | pCMV_ecTadA-(SGGS)2- XTEN-(SGGS)2_ nCas9_SGGS_NLS | P48S_A142N |
| pNMG-546 | pCMV_ecTadA-(SGGS)2- XTEN-(SGGS)2_ nCas9_SGGS_NLS | P48T_I49V_A142N |
| pNMG-547 | pCMV_ecTadA- (SGGS)2-XTEN- (SGGS)2-ecTadA- (SGGS)2-XTEN- (SGGS)2_nCas9_ SGGS_NLS | (wt) + (P48S_L84F_ A106V_D108N_H123Y_ A142N_D147Y_ E155V_I156F) |
| pNMG-548 | pCMV_ecTadA- (SGGS)2-XTEN- (SGGS)2-ecTadA- (SGGS)2-XTEN- (SGGS)2_nCas9_ SGGS_NLS | (P48S_L84F_A106V_ D108N_H123Y_A142N_ D147Y_E155V_ I156F) + (P48S_L84F_ A106V_D108N_H123Y_ A142N_D147Y_ E155V_I156F)) |
| pNMG-549 | pCMV_ecTadA-(SGGS)2- XTEN-(SGGS)2-ecTadA- (SGGS)2-XTEN- (SGGS)2_nCas9_ SGGS_NLS | (P48S_A142N) + (P48S_L84F_A106V_ D108N_H123Y_ A142N_D147Y_ E155V_I156F)) |
| pNMG-550 | pCMV_ecTadA-(SGGS)2- XTEN-(SGGS)2- ecTadA-(SGGS)2-XTEN- (SGGS)2_nCas9_ SGGS_NLS | (P48S_A142N) + (L84F_A106V_D108N_ H123Y_D147Y_E155V_ I156F) |
| pNMG-551 | pCMV_ecTadA-(SGGS)2- XTEN-(SGGS)2- ecTadA-(SGGS)2-XTEN- (SGGS)2_nCas9_ SGGS_NLS | (wt) + (P48T_I49V_ L84F_A106V_D108N_ H123Y_A142N_ D147Y_E155V_I156F_ L157N) |
| pNMG-552 | pCMV_ecTadA-(SGGS)2- XTEN-(SGGS)2- ecTadA-(SGGS)2-XTEN- (SGGS)2_nCas9_ SGGS_NLS | (P48T_I49V_L84F_ A106V_D108N_ H123Y_A142N_ D147Y_E155V_I156F_ L157N) + (P48T_I49V_ L84F_A106V_D108N_ H123Y_A142N_ D147Y_E155V_I156F_ L157N) |
| pNMG-553 | pCMV_ecTadA-(SGGS)2- XTEN-(SGGS)2- ecTadA-(SGGS)2-XTEN- (SGGS)2_nCas9_ SGGS_NLS | (P48T_I49V_A142N) + (P48T_I49V_L84F_ A106V_D108N_H123Y_ A142N_D147Y_ E155V_I156F_L157N) |
| pNMG-554 | pCMV_ecTadA-(SGGS)2- XTEN-(SGGS)2- ecTadA-(SGGS)2-XTEN- (SGGS)2_nCas9_ SGGS_NLS | (P48T_I49V_A142N) + (L84F_A106V_D108N_ H123Y_D147Y_E155V_ I156F) |
| pNMG-555 | pCMV_ecTadA-24 a.a. linker-ecTadA-24 a.a. linker_nCas9_SGGS_NLS | (wt) + (H36L_R51L_ L84F_A106V_D108N_ H123Y_S146C_D147Y_ E155V_I156F_K157N) |
| pNMG-556 | pCMV_ecTadA-24 a.a. linker-ecTadA-24 a.a. linker_nCas9_SGGS_NLS | (wt) + (H36L_R51L_ L84F_A106V_D108N_ H123Y_S146C_ D147Y_E155V_ I156F_K157N) |
| pNMG-557 | pCMV_ecTadA-24 a.a. linker-ecTadA-24 a.a. linker_nCas9_SGGS_NLS | (wt) + (H36L_R51L_ L84F_A106V_D108N_ H123Y_S146C_ D147Y_E155V_ I156F_K157N) |
| pNMG-558 | pCMV_ecTadA-24 a.a. linker-ecTadA-24 a.a. linker_nCas9_SGGS_NLS | (wt) + (H36L_R51L_ L84F_A106V_D108N_ H123Y_S146C_ D147Y_E155V_ I156F_K157N) |
| pNMG-559 | pCMV_ecTadA-24 a.a. linker-ecTadA-24 a.a. linker_nCas9_SGGS_NLS | (wt) + (H36L_R51L_ L84F_A106V_D108N_ H123Y_S146C_ D147Y_E155V_ I156F_K157N) |
| pNMG-560 | pCMV_ecTadA-24 a.a. linker-ecTadA-24 a.a. linker_nCas9_SGGS_NLS | (wt) + (H36L_R51L_ L84F_A106V_D108N_ H123Y_S146C_ D147Y_E155V_ I156F_K157N) |

TABLE 1-continued

| EcTadA mutants for A to G nucleobase editor | | |
|---|---|---|
| Name | Construct Architecture | Mutations in TadA |
| pNMG-561 | pCMV_ecTadA-24 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-562 | pCMV_ecTadA-24 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-563 | pCMV_ecTadA-24 a.a. linker-ecTadA-24 a.a. linker_nCas9_SGGS_NLS | wild-type |
| pNMG-564 | pCMV_ecTadA-24 a.a. linker-ecTadA-24 a.a. linker_nCas9_SGGS_NLS | (H36L_R51L_L84F_A106V_D108N_H123Y_S146C_D147Y_E155V_I156F_K157N) |
| pNMG-565 | pCMV_ecTadA-(SGGS)2-XTEN-(SGGS)2-ecTadA-(SGGS)2-XTEN-(SGGS)2_nCas9_XTEN_MBD4_SGGS_NLS | (wt) + (H36L_R51L_L84F_A106V_D108N_H123Y_S146C_D147Y_E155V_I156F_K157N) |
| pNMG-566 | pCMV_ecTadA-(SGGS)2-XTEN-(SGGS)2-ecTadA-(SGGS)2-XTEN-(SGGS)2_nCas9_XTEN_TDG_SGGS_NLS | (wt) + (H36L_R51L_L84F_A106V_D108N_H123Y_S146C_D147Y_E155V_I156F_K157N) |
| pNMG-572 | pCMV_ecTadA- 32 a.a.-_nCas9_SGGS_NLS | (H36L_P48S_R51L_L84F_A106V_D108N_H123Y_S146C_D147Y_E155V_I156F_K157N) |
| pNMG-573 | pCMV_ecTadA- 32 a.a.-_nCas9_SGGS_NLS | (H36L_P48S_R51L_L84F_A106V_D108N_H123Y_S146C_A142N_D147Y_E155V_I156F_K157N) |
| pNMG-574 | pCMV_ecTadA- 32 a.a.-_nCas9_SGGS_NLS | (H36L_P48T_I49V_R51L_L84F_A106V_D108N_H123Y_S146C_D147Y_E155V_I156F_K157N) |
| pNMG-575 | pCMV_ecTadA- 32 a.a.-_nCas9_SGGS_NLS | (H36L_P48T_I49V_R51L_L84F_A106V_D108N_H123Y_A142N_S146C_D147Y_E155V_I156F_K157N) |
| pNMG-576 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_D147Y_E155V_I156F_K157N) |
| pNMG-577 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_A142N_S146C_D147Y_R152P_E155V_I156F_K157N) |
| pNMG-578 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_S146C_D147Y_E155V_I156F_K157N) |
| pNMG-579 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_A142N_S146C_D147Y_R152P_E155V_I156F_K157N) |
| pNMG-580 | pCMV_ecTadA-(SGGS)2-XTEN-(SGGS)2-ecTadA-(SGGS)2-XTEN-(SGGS)2_nCas9_SGGS_NLS | (H36L_P48S_R51L_L84F_A106V_D108N_H123Y_S146C_D147Y_E155V_I156F_K157N) + (H36L_P48S_R51L_L84F_A106V_D108N_H123Y_S146C_D147Y_E155V_I156F_K157N) |
| pNMG-581 | pCMV_ecTadA- 32 a.a.-_nCas9_SGGS_NLS | (H36L_P48A_R51L_L84F_A106V_D108N_H123Y_S146C_D147Y_E155V_I156F_K157N) |
| pNMG-583 | pCMV_ecTadA- 32 a.a.-_nCas9_SGGS_NLS | (H36L_P48A_R51L_L84F_A106V_D108N_H123Y_A142N_S146C_D147Y_E155V_I156F_K157N) |
| pNMG-586 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_E155V_I156F_K157N) |
| pNMG-588 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_A142N_S146C_D147Y_R152P_E155V_I156F_K157N) |
| pNMG-603 | pCMV_ecTadA- 32 a.a.-_nCas9_SGGS_NLS | (W23L_H36L_P48A_R51L_L84F_A106V_D108N_H123Y_S146C_D147Y_E155V_I156F_K157N) |
| pNMG-604 | pCMV_ecTadA- 32 a.a.-_nCas9_SGGS_NLS | (W23R_H36L_P48A_R51L_L84F_A106V_D108N_H123Y_S146C_D147Y_E155V_I156F_K157N) |
| pNMG-605 | pCMV_ecTadA- 32 a.a.-_nCas9_SGGS_NLS | (W23L_H36L_P48A_R51L_L84F_A106V_D108N_H123Y_S146R_D147Y_E155V_I156F_K161T) |
| pNMG-606 | pCMV_ecTadA- 32 a.a.-_nCas9_SGGS_NLS | (H36L_P48A_R51L_L84F_A106V_D108N_H123Y_S146C_D147Y_R152H_E155V_I156F_K157N) |
| pNMG-607 | pCMV_ecTadA- 32 a.a.-_nCas9_SGGS_NLS | (H36L_P48A_R51L_L84F_A106V_D108N_H123Y_S146C_D147Y_R152P_E155V_I156F_K157N) |
| pNMG-608 | pCMV_ecTadA- 32 a.a.-_nCas9_SGGS_NLS | (W23L_H36L_P48A_R51L_L84F_A106V_D108N_H123Y_S146C_D147Y_R152P_E155V_I156F_K157N) |
| pNMG-609 | pCMV_ecTadA- 32 a.a.-_nCas9_SGGS_NLS | (W23L_H36L_P48A_R51L_L84F_A106V_D108N_H123Y_A142A_S146C_D147Y_E155V_I156F_K157N) |
| pNMG-610 | pCMV_ecTadA- 32 a.a.-_nCas9_SGGS_NLS | (W23L_H36L_P48A_R51L_L84F_A106V_D108N_H123Y_A142A_S146C_D147Y_R152P_E155V_I156F_K157N) |
| pNMG-611 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_E155V_I156F_K157N) |
| pNMG-612 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_E155V_I156F_K157N) |
| pNMG-613 | pCMV_ecTadA-(SGGS)2-XTEN-(SGGS)2-ecTadA-(SGGS)2- | (wt) + (W23L_H36L_P48A_R51L_L84F_A106V_D108N_ |

TABLE 1-continued

EcTadA mutants for A to G nucleobase editor

| Name | Construct Architecture | Mutations in TadA |
|---|---|---|
| | XTEN-(SGGS)2_nCas9_ SGGS_NLS | H123Y_S146R_D147Y_ E155V_I156F_K161T) |
| pNMG-614 | pCMV_ecTadA-(SGGS)2- XTEN-(SGGS)2- ecTadA-(SGGS)2- XTEN-(SGGS)2_nCas9_ SGGS_NLS | (wt) + (H36L_P48A_ R51L_L84F_A106V_ D108N_H123Y_A142N_ S146C_D147Y_R152P_ E155V_I156F_K157N) |
| pNMG-615 | pCMV_ecTadA-(SGGS)2- XTEN-(SGGS)2- ecTadA-(SGGS)2- XTEN-(SGGS)2_nCas9_ SGGS_NLS | (wt) + (H36L_P48A_ R51L_L84F_A106V_ D108N_H123Y_A142N_ S146C_D147Y_R152P_ E155V_I156F_K157N) |
| pNMG-616 | pCMV_ecTadA-(SGGS)2- XTEN-(SGGS)2- ecTadA-(SGGS)2- XTEN-(SGGS)2_nCas9_ SGGS_NLS | (wt) + (W23L_H36L_ P48A_R51L_L84F_ A106V_D108N_H123Y_ S146C_D147Y_R152P_ E155V_I156F_K157N) |
| pNMG-617 | pCMV_ecTadA-(SGGS)2- XTEN-(SGGS)2- ecTadA-(SGGS)2- XTEN-(SGGS)2_nCas9_ SGGS_NLS | (wt) + (W23L_H36L_ P48A_R51L_L84F_ A106V_D108N_ H123Y_S146C_D147Y_ R152P_E155V_I156F_ K157N) |
| pNMG-618 | pCMV_ecTadA-(SGGS)2- XTEN-(SGGS)2- ecTadA-(SGGS)2- XTEN-(SGGS)2_nCas9_ SGGS_NLS | (wt) + (W23L_H36L_ P48A_R51L_L84F_ A106V_D108N_H123Y_ S146C_D147Y_R152P_ E155V_I156F_K157N) |
| pNMG-619 | pCMV_ecTadA- 32 a.a.-_nCas9_ SGGS_NLS_K157N) | (W23R_H36L_P48A_ R51L_L84F_A106V_ D108N_H123Y_S146C_ D147Y_R152P_ E155V_I156F |
| pNMG-620 | pCMV_ecTadA-(SGGS)2- XTEN-(SGGS)2- ecTadA-(SGGS)2- XTEN-(SGGS)2_nCas9_ SGGS_NLS | (wt) + (W23R_H36L_ P48A_R51L_L84F_ A106V_D108N_H123Y_ S146C_D147Y_R152P_ E155V_I156F_K157N) |
| pNMG-621 | pCMV_ecTadA- 32 a.a. linker-ecTadA- 24 a.a. linker_nCas9_SGGS_NLS | (wt) + (H36L_P48A_ R51L_L84F_A106V_ D108N_H123Y_A142N_ S146C_D147Y_R152P_ E155V_I156F_K157N) |
| pNMG-622 | pCMV_ecTadA- 32 a.a. linker-ecTadA- 24 a.a. linker_nCas9_SGGS_NLS | (wt) + (H36L_P48A_ R51L_L84F_A106V_ D108N_H123Y_A142N_ S146C_D147Y_R152P_ E155V_I156F_K157N) |
| pNMG-623 | pCMV_ecTadA- 32 a.a. linker-ecTadA- 24 a.a. linker_nCas9_SGGS_NLS | (wt) + (W23L_H36L_P48A_ R51L_L84F_A106V_ D108N_H123Y_S146C_ D147Y_R152P_E155V_ I156F_K157N) |
| pNMG-624 | pCMV_ecTadA- 32 a.a. linker-ecTadA- 24 a.a. linker_nCas9_SGGS_NLS | (wt) + (W23R_ H36L_P48A_R51L_ L84F_A106V_D108N_ H123Y_S146C_ D147Y_R152P_ E155V_I156F_ K157N) |

In some embodiments, the adenosine deaminase comprises one or more of a W23X, H36X, N37X, P48X, I49X, R51X, N72X, L84X, S97X, A106X, D108X, H123X, G125X, A142X, S146X, D147X, R152X, E155X, I156X, K157X, and/or K161X mutation in SEQ ID NO: 314, or one or more corresponding mutations in another adenosine deaminase, where the presence of X indicates any amino acid other than the corresponding amino acid in the wild-type adenosine deaminase. In some embodiments, the adenosine deaminase comprises one or more of W23L, W23R, H36L, P48S, P48A, R51L, L84F, A106V, D108N, H123Y, A142N, S146C, D147Y, R152P, E155V, I156F, and/or K157N mutation in SEQ ID NO: 314, or one or more corresponding mutations in another adenosine deaminase.

In some embodiments, the adenosine deaminase comprises or consists of one, two, three, four, five, six, seven, eight, nine, ten, eleven, or twelve mutations selected from H36X, P48X, R51X, L84X, A106X, D108X, H123X, S146X, D147X, E155X, I156X, and K157X in SEQ ID NO: 314, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, or twelve mutations selected from H36L, P48S, R51L, L84F, A106V, D108N, H123Y, S146C, D147Y, E155V, I156F, and K157N in SEQ ID NO: 314, or a corresponding mutation or mutations in another adenosine deaminase. In some embodiments, the adenosine deaminase comprises or consists of a H36L, P48S, R51L, L84F, A106V, D108N, H123Y, S146C, D147Y, E155V, I156F, and K157N mutation in SEQ ID NO: 314, or corresponding mutations in another adenosine deaminase.

In some embodiments, the adenosine deaminase comprises or consists of one, two, three, four, five, six, seven, eight, nine, ten, eleven, twelve, or thirteen mutations selected from H36X, P48X, R51X, L84X, A106X, D108X, H123X, A142X, S146X, D147X, E155X, I156X, and K157X in SEQ ID NO: 314, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, or thirteen mutations selected from H36L, P48S, R51L, L84F, A106V, D108N, H123Y, A142N, S146C, D147Y, E155V, I156F, and K157N in SEQ ID NO: 314, or a corresponding mutation or mutations in another adenosine deaminase. In some embodiments, the adenosine deaminase comprises or consists of a H36L, P48S, R51L, L84F, A106V, D108N, H123Y, A142N, S146C, D147Y, E155V, I156F, and K157N mutation in SEQ ID NO: 314, or corresponding mutations in another adenosine deaminase.

In some embodiments, the adenosine deaminase comprises or consists of one, two, three, four, five, six, seven, eight, nine, ten, eleven, twelve, thirteen, or fourteen mutations selected from W23X, H36X, P48X, R51X, L84X, A106X, D108X, H123X, A142X, S146X, D147X, E155X, I156X, and K157X in SEQ ID NO: 314, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, or fourteen mutations selected from W23L, H36L, P48A, R51L, L84F, A106V, D108N, H123Y, A142N, S146C, D147Y, E155V, I156F, and K157N in SEQ ID NO: 314, or a corresponding mutation or mutations in another adenosine deaminase. In some embodiments, the adenosine deaminase comprises or consists of a W23L, H36L, P48A, R51L, L84F, A106V, D108N, H123Y, A142N, S146C, D147Y, E155V, I156F, and K157N mutation in SEQ ID NO: 314, or corresponding mutations in another adenosine deaminase.

In some embodiments, the adenosine deaminase comprises or consists of one, two, three, four, five, six, seven, eight, nine, ten, eleven, twelve, thirteen, fourteen, or fifteen mutations selected from W23X, H36X, P48X, R51X, L84X, A106X, D108X, H123X, A142X, S146X, D147X, R152X, E155X, I156X, and K157X in SEQ ID NO: 314, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, fourteen, or fifteen mutations selected from W23L, H36L, P48A, R51L, L84F, A106V, D108N, H123Y, A142N, S146C, D147Y, R152P, E155V, I156F, and K157N in SEQ ID NO: 314, or a corresponding mutation or mutations in another adenosine deaminase. In some embodiments, the adenosine deaminase comprises or consists of a W23L, H36L, P48A, R51L, L84F, A106V, D108N, H123Y, A142N, S146C, D147Y, R152P, E155V, I156F, and K157N mutation in SEQ ID NO: 314, or corresponding mutations in another adenosine deaminase.

In some embodiments, the adenosine deaminase comprises or consists of one, two, three, four, five, six, seven, eight, nine, ten, eleven, twelve, thirteen, or fourteen mutations selected from W23X, H36X, P48X, R51X, L84X, A106X, D108X, H123X, S146X, D147X, R152X, E155X, I156X, and K157X in SEQ ID NO: 314, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, or fourteen mutations selected from W23R, H36L, P48A, R51L, L84F, A106V, D108N, H123Y, S146C, D147Y, R152P, E155V, I156F, and K157N in SEQ ID NO: 314, or a corresponding mutation or mutations in another adenosine deaminase. In some embodiments, the adenosine deaminase comprises or consists of a W23R, H36L, P48A, R51L, L84F, A106V, D108N, H123Y, S146C, D147Y, R152P, E155V, I156F, and K157N mutation in SEQ ID NO: 314, or corresponding mutations in another adenosine deaminase.

Nucleobase Editors

In some aspects, split nucleobase editors may be used in the present disclosure. Some aspects of the present disclosure relate to compositions comprising (i) a first nucleotide sequence encoding an N-terminal portion of a nucleobase editor fused at its C-terminus to an intein-N; and (ii) a second nucleotide sequence encoding an intein-C fused to the N-terminus of a C-terminal portion of the nucleobase editor.

Nucleobase editor variants are contemplated. For example, a nucleobase editor variant may also be "split" as described herein. The split nucleobase editors may comprise an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the nucleobase editor sequences (SEQ ID NOs: 303-313, 362, 364, 365, 369-372, 399-406, 482, 489-490, 515-518, 550-552, and NOs: 323-342, 379-383, 385-388, 458-478, 480, 483, and 553) provided herein.

In some embodiments, the N-terminal portion of a split nucleobase editor comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the corresponding N-terminal portion of any one of the nucleobase editors provided herein (e.g., a nucleobase editor comprising an N-terminal amino acid sequence of any one of SEQ ID NOs: 303-313, 362, 364, 365, 369-372, 399-406, 482, 489-490, 515-518, 550-552, and SEQ ID NOs: 323-342, 379-383, 385-388, 458-478, 480, 483, and 553). In some embodiments, the N-terminal portion of the split nucleobase editor comprises an amino acid sequence that is shorter or longer in length (e.g., by no more than 30%, no more than 25%, no more than 20%, no more than 15%, no more than 10%, no more than 5%, no more than 1% longer or shorter) than the corresponding portion of any of the nucleobase editors provided herein. In some embodiments, the N-terminal portion of the split nucleobase editor comprises an amino acid sequence that is shorter or longer in length (e.g., by no more than 200 amino acids, no more than 150 amino acids, no more than 100 amino acids, no more than 50 amino acids, no more than 10 amino acids, no more than 5 amino acids, or no more than 2 amino acids longer or shorter) than the corresponding portion of any of the nucleobase editors provided herein.

In some embodiments, the C-terminal portion of a split nucleobase editor comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to the corresponding C-terminal portion of any one of the nucleobase editors provided herein (e.g., a nucleobase editor comprising a C-terminal amino acid sequence of any one of SEQ ID NOs: 303-313, 362, 364, 365, 369-372, 399-406, 482, 489-490, 515-518, 550-552, or SEQ ID NOs: 323-342, 379-383, 385-388, 458-478, 480, 483, and 553). In some embodiments, the C-terminal portion of the split nucleobase editor comprises an amino acid sequence that is shorter or longer in length (e.g., by no more than 30%, no more than 25%, no more than 20%, no more than 15%, no more than 10%, no more than 5%, no more than 1% longer or shorter) than the corresponding portion of any of the nucleobase editors provided herein. In some embodiments, the C-terminal portion of the split nucleobase editor comprises an amino acid sequence that is shorter or longer in length (e.g., by no more than 200 amino acids, no more than 150 amino acids, no more than 100 amino acids, no more than 50 amino acids, no more than 10 amino acids, no more than 5 amino acids, or no more than 2 amino acids longer or shorter) than the corresponding portion of any of the nucleobase editors provided herein.

Exemplary adenine and cytidine nucleobase editors are described in Rees & Liu, Base editing: precision chemistry on the genome and transcriptome of living cells, *Nat. Rev. Genet.* 2018; 19(12):770-788; as well as U.S. Patent Publication No. 2018/0073012, published Mar. 15, 2018, which issued as U.S. Pat. No. 10,113,163, on Oct. 30, 2018; U.S. Patent Publication No. 2017/0121693, published May 4, 2017, which issued as U.S. Pat. No. 10,167,457 on Jan. 1, 2019; PCT Publication No. WO 2017/070633, published Apr. 27, 2017; U.S. Patent Publication No. 2015/0166980, published Jun. 18, 2015; U.S. Pat. No. 9,840,699, issued Dec. 12, 2017; and U.S. Pat. No. 10,077,453, issued Sep. 18, 2018, the contents of each of which are incorporated herein by reference in their entireties.

Non-limiting, exemplary types of nucleobase editors (including C to T, A to G, and C to G nucleobase editors) and their respective sequences are provided below. In some embodiments, the nucleobase editor is a variant of the nucleobase editors described herein. For example, in some embodiments, the nucleobase editor is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a nucleobase editor described herein (exemplary sequences are provided below). In some embodiments, the nucleobase editor comprises an amino acid sequence that is shorter or longer in length (e.g., by no more than 30%, no more than 25%, no more than 20%, no more than 15%, no more than 10%, no more than 5%, no more than 1% longer or shorter) than any of the nucleobase editors provided herein. In some embodiments, the nucleobase editor comprises an amino acid sequence that is shorter or longer in length (e.g., by no more than 500 amino acids, no more than 450 amino acids, no more than 400 amino acids, no more than 350 amino acids, no more than 300 amino acids, no more than 250 amino acids, no more than 200 amino acids, no more than 200 amino acids, no more than 150 amino acids, no more than 100 amino acids, no more than 50 amino acids, no more than 10 amino acids, no more than 5 amino acids longer or shorter) than any of the nucleobase editors provided herein.

Cytidine Nucleobase Editors

In some aspects, the methods of the present disclosure provides cytidine nucleobase editors (CBEs) comprising a napDNAbp domain and a cytosine deaminase domain that enzymatically deaminates a cytosine nucleobase of a C:G nucleobase pair to a uracil. The uracil may be subsequently converted to a thymine (T) by the cell's DNA repair and replication machinery. The mismatched guanine (G) on the opposite strand may subsequently be converted to an adenine (A) by the cell's DNA repair and replication machinery. In this manner, a target C:G nucleobase pair is ultimately converted to a T:A nucleobase pair.

In some aspects, the base editing methods of the disclosure comprise the use of a cytidine nucleobase editor. Exemplary cytidine nucleobase editors include, but are not limited to, BE3, BE3.9max, BE4max, BE4-SaKKH, BE3.9-NG, BE3.9-NRRH, or BE4max-VRQR. In certain embodiments, the cytidine nucleobase editor used in the disclosed methods is a BE4max, BE4-SaKKH, BE4max-VQR, or BE4max-VRQR. Other CBEs may be used to deaminate a C nucleobase in accordance with the disclosed methods.

In some aspects, the disclosure provides complexes of nucleobase editors and guide RNAs that comprise a CBE. Exemplary cytidine nucleobase editors of the disclosed complexes include, but are not limited to, BE3, BE3.9max, BE4max, BE4-SaKKH, BE3.9-NG, BE3.9-NRRH, BE4max-VQR, or BE4max-VRQR. In certain embodiments, the cytidine nucleobase editor used in the disclosed complexes is a BE4max, BE4-SaKKH, BE4max-VQR, or BE4max-VRQR. Other CBEs may be used to deaminate a C nucleobase in accordance with the disclosed complexes.

Exemplary complexes of CBEs may provide an off-target editing frequency of less than 2.0% after being contacted with a nucleic acid molecule comprising a target sequence, e.g., a target nucleobase pair. Further exemplary CBE complexes provide an off-target editing frequency of less than 1.5% after being contacted with a nucleic acid molecule comprising a target sequence comprising a target nucleobase pair. Further exemplary CBE complexes may provide an off-target editing frequency of less than 1.25%, less than 1.1%, less than 1%, less than 0.75%, less than 0.5%, less than 0.4%, less than 0.25%, less than 0.2%, less than 0.15%, less than 0.1%, less than 0.05%, or less than 0.025%, after being contacted with a nucleic acid molecule comprising a target sequence.

For instance, the cytidine nucleobase editors YE1-BE4, YE1-CP1028, YE1-SpCas9-NG (also referred to herein as YE1-NG), R33A-BE4, and R33A+K34A-BE4-CP1028, which are described below, may exhibit off-target editing frequencies of less than 0.75% (e.g., about 0.4% or less) while maintaining on-target editing efficiencies of about 60% or more, in target sequences in mammalian cells. Each of these nucleobase editors comprises modified cytosine deaminases (e.g., YE1, R33A, or R33A+K34A) and may further comprise a Cas9 domain with an expanded PAM window (e.g., SpCas9-NG or circularly permuted Cas9 domains, e.g., CP1028). These five nucleobase editors may be the most preferred for applications in which off-target editing, and in particular Cas9-independent off-target editing, must be minimized. In particular, nucleobase editors comprising a YE1 deaminase domain provide efficient on-target editing with greatly decreased Cas9-independent editing, as confirmed by whole-genome sequencing.

Exemplary CBEs may further possess an on-target editing efficiency of more than 50% after being contacted with a nucleic acid molecule comprising a target sequence. Further exemplary CBEs possess an on-target editing efficiency of more than 60% after being contacted with a nucleic acid molecule comprising a target sequence. Further exemplary CBEs possess an on-target editing efficiency of more than 65%, more than 70%, more than 75%, more than 80%, more than 82.5%, or more than 85% after being contacted with a nucleic acid molecule comprising a target sequence. The disclosed CBEs may exhibit indel frequencies of less than 0.75%, less than 0.6%, less than 0.5%, less than 0.4%, less than 0.3%, or less than 0.2% after being contacted with a nucleic acid molecule containing a target sequence.

The disclosed CBEs may further comprise one or more nuclear localization signals (NLSs) and/or two or more uracil glycosylase inhibitor (UGI) domains. Thus, the nucleobase editors may comprise the structure: $NH_2$-[first nuclear localization sequence]-[cytosine deaminase domain]-[napDNAbp domain]-[first UGI domain]-[second UGI domain]-[second nuclear localization sequence]-COOH, wherein each instance of "]-[" indicates the presence of an optional linker sequence. Exemplary CBEs may have a structure that comprises the "BE4max" architecture, with an $NH_2$-[NLS]-[cytosine deaminase]-[Cas9 nickase]-[UGI domain]-[UGI domain]-[NLS]-COOH structure, having optimized nuclear localization signals and wherein the napDNAbp domain comprises a Cas9 nickase. This BE4max structure was reported to have optimized codon usage for expression in human cells, as reported in Koblan et al., *Nat Biotechnol.* 2018; 36(9):843-846, herein incorporated by reference.

In other embodiments, exemplary CBEs may have a structure that comprises a modified BE4max architecture that contains a napDNAbp domain comprising a Cas9 variant other than Cas9 nickase, such as SpCas9-NG, xCas9, or circular permutant CP1028. Accordingly, exemplary CBEs may comprise the structure: $NH_2$-[NLS]-[cytosine deaminase]-[xCas9]-[UGI domain]-[UGI domain]-[NLS]-COOH; or $NH_2$-[NLS]-[cytosine deaminase]-[SpCas9-NG]-[UGI domain]-[UGI domain]-[NLS]-COOH, wherein each instance of "]-[" indicates the presence of an optional linker sequence.

The disclosed CBEs may comprise modified (or evolved) cytosine deaminase domains, such as deaminase domains that recognize an expanded PAM sequence, have improved efficiency of deaminating 5'-GC targets, and/or make edits in a narrower target window, In some embodiments, the disclosed cytidine nucleobase editors comprise evolved nucleic acid programmable DNA binding proteins (napDNAbp), such as an evolved Cas9.

Exemplary cytidine nucleobase editors comprise amino acid sequences that are at least least 85%, at least 90%, at least 95%, at least 98%, at least 99%, or at least 99.5% identical to any one of the amino acid sequences SEQ ID NOs: 362, 365, 370-372, 399, 482, 489, 490, and 515-518. In particular embodiments, the disclosed cytidine nucleobase editors comprise an amino acid sequence that is at least 90% identical to any one of SEQ ID NOs: 365, 372, 399, 482, and 490. In particular embodiments, the disclosed cytidine nucleobase editors comprise the amino acid sequence of any one of SEQ ID NOs: 365, 372, 399, 482, and 490.

Where indicated, "BE4-" and "—BE4" refer to the BE4max architecture, or $NH_2$-[first nuclear localization sequence]-[cytosine deaminase domain]-[32aa linker]-[SpCas9 nickase (nCas9, or nSpCas9) domain]-[9aa linker]-[first UGI domain]-[9aa-linker]-[second UGI domain]-[second nuclear localization sequence]-COOH. Where indicated, "BE4max, modified with SpCas9-NG" and "—SpCas9-NG" refer to a modified BE4max architecture in which the SpCas9 nickase domain has been replaced with an SpCas9-NG, i.e., $NH_2$-[first nuclear localization sequence]-[cytosine deaminase domain]-[32aa linker]-[SpCas9-NG]-[9aa linker]-[first UGI domain]-[9aa-linker]-[second UGI domain]-[second nuclear localization sequence]-COOH.

As discussed above, preferred nucleobase editors comprise modified cytosine deaminases (e.g., YE1, R33A, or R33A+K34A) and may further comprise a modified napDNAbp domain such as a Cas9 domain with an expanded PAM window (e.g., SpCas9-NG). For the purposes of clarity, the cytosine deaminase domain in some of the following amino acid sequences may be indicated in Bold, and the napDNAbp domains may be indicated in underline.

Non-limiting examples of C to T nucleobase editors are provided below, as SEQ ID NOs: 303-313, 362, 364, 365, 367, 369-372, 399-406, 482, 489-490, 515-518, and 550-552.

$His_6$-rAPOBEC1-XTEN-dCas9 for *Escherichia coli* expression (SEQ ID NO: 303)

MGSSHHHHHHMSSETGPVAVDPTLRRRIEPHEFEVFFDPRELRKETCLLYEINWGGRHSIWRHTSQ

NTNKHVEVNFIEKFTTERYFCPNTRCSITWFLSWSPCGECSRAITEFLSRYPHVTLFIYIARLYHHAD

PRNRQGLRDLISSGVTIQIMTEQESGYCWRNFVNYSPSNEAHWPRYPHLWVRLYVLELYCIILGLP

PCLNILRRKQPQLTFFTIALQSCHYQRLPPHILWATGLKSGSETPGTSESATPESDKKYSIGLAIGTNS

VGWAVITDEYKVPSKKFKVLGNTDRHSIKKNLIGALLFDSGETAEATRLKRTARRRYTRRKNRIC

YLQEIFSNEMAKVDDSFFHRLEESFLVEEDKKHERHPIFGNIVDEVAYHEKYPTIYHLRKKLVDST

DKADLRLIYLALAHMIKFRGHFLIEGDLNPDNSDVDKLFIQLVQTYNQLFEENPINASGVDAKAILS

ARLSKSRRLENLIAQLPGEKKNGLFGNLIALSLGLTPNFKSNFDLAEDAKLQLSKDTYDDDLDNLL

AQIGDQYADLFLAAKNLSDAILLSDILRVNTEITKAPLSASMIKRYDEHHQDLTLLKALVRQQLPE

KYKEIFFDQSKNGYAGYIDGGASQEEFYKFIKPILEKMDGTEELLVKLNREDLLRKQRTFDNGSIPH

QIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQK

KAIVDLLFKTNRKVTVKQLKEDYFKKIECFDSVEISGVEDRFNASLGTYHDLLK11KDKDFLDNEEN

EDILEDIVLTLTLFEDREMIEERLKTYAHLFDDKVMKQLKRRRYTGWGRLSRKLINGIRDKQSGKT

ILDFLKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQLQNE

KLYLYYLQNGRDMYVDQELDINRLSDYDVDAIVPQSFLKDDSIDNKVLTRSDKNRGKSDNVPSEE

VVKKMKNYWRQLLNAKLITQRKFDNLTKAERGGLSELDKAGFIKRQLVETRQITKHVAQILDSR

MNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETG

EIVWDKGRDFATVRKVLSMPQVNIVKKTEVQTGGFSKESILPKRNSDKLIARKKDWDPKKYGGFD

SPTVAYSVLVVAKVEKGKSKKLKSVKELLGITIMERSSFEKNPIDFLEAKGYKEVKKDL11KLPKYS

LFELENGRKRMLASAGELQKGNELALPSKYVNFLYLASHYEKLKGSPEDNEQKQLFVEQHKHYL

DE11EQISEFSKRVILADANLDKVLSAYNKHRDKPIREQAEN11HLFTLTNLGAPAAFKYFDTTIDRKR

YTSTKEVLDATLIHQSITGLYETRIDLSQLGGDSGGSPKKKRKV rAPOBEC1-XTEN-dCas9-NLS for mammalian expression (SEQ ID NO: 304)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCHLGLPPCLNILRRKQPQ

-continued

LTFFTIALQSCHYQRLPPHILWATGLKSGSETPGTSESATPESDKKYSIGLAIGTNSVGWAVITDEYK
VPSKKFKVLGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKADLRLIYLAL
AHMIKFRGHFLIEGDLNPDNSDVDKLFIQLVQTYNQLFEENPINASGVDAKAILSARLSKSRRLENL
IAQLPGEKKNGLFGNLIALSLGLTPNFKSNFDLAEDAKLQLSKDTYDDDLDNLLAQIGDQYADLFL
AAKNLSDAILLSDILRVNTEITKAPLSASMIKRYDEHHQDLTLLKALVRQQLPEKYKEIFFDQSKNG
YAGYIDGGASQEEFYKFIKPILEKMDGTEELLVKLNREDLLRKQRTFDNGSIPHQIHLGELHAILRR
QEDFYPFLKDNREKIEKILTFRIPYYVGPLARGNSRFAWMTRKSEETITPWNFEEVVDKGASAQSFI
ERMTNFDKNLPNEKVLPKHSLLYEYFTVYNELTKVKYVTEGMRKPAFLSGEQKKAIVDLLFKTNR
KVTVKQLKEDYFKKIECFDSVEISGVEDRFNASLGTYHDLLK11KDKDFLDNEENEDILEDIVLTLTL
FEDREMIEERLKTYAHLFDDKVMKQLKRRRYTGWGRLSRKLINGIRDKQSGKTILDFLKSDGFAN
RNFMQLIHDDSLTFKEDIQKAQVSGQGDSLHEHIANLAGSPAIKKGILQTVKVVDELVKVMGRHK
PENIVIEMARENQTTQKGQKNSRERMKRIEEGIKELGSQILKEHPVENTQLQNEKLYLYYLQNGRD
MYVDQELDINRLSDYDVDAIVPQSFLKDDSIDNKVLTRSDKNRGKSDNVPSEEVVKKMKNYWRQ
LLNAKLITQRKFDNLTKAERGGLSELDKAGFIKRQLVETRQITKHVAQILDSRMNTKYDENDKLIR
EVKVITLKSKLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWDKGRDFATV
RKVLSMPQVNIVKKTEVQTGGFSKESILPKRNSDKLIARKKDWDPKKYGGFDSPTVAYSVLVVAK
VEKGKSKKLKSVKELLGITIMERSSFEKNPIDFLEAKGYKEVKKDL11KLPKYSLFELENGRKRMLA
SAGELQKGNELALPSKYVNFLYLASHYEKLKGSPEDNEQKQLFVEQHKHYLDE11EQISEFSKRVIL
ADANLDKVLSAYNKHRDKPIREQAEN11HLFTLTNLGAPAAFKYFDTTIDRKRYTSTKEVLDATLIH
QSITGLYETRIDLSQLGGDSGGSPKKKRKV hAPOBEC1-XTEN-dCas9-NLS for Mammalian expression
(SEQ ID NO: 305)
MTSEKGPSTGDPTLRRRIEPWEFDVFYDPRELRKEACLLYEIKWGMSRKIWRSSGKNTTNHVEVN
FIKKFTSERDFHPSMSCSITWFLSWSPCWECSQAIREFLSRHPGVTLVIYVARLFWHMDQQNRQGL
RDLVNSGVTIQIMRASEYYHCWRNFVNYPPGDEAHWPQYPPLWMMLYALELHCIILSLPPCLKISR
RWQNHLTFFRLHLQNCHYQTIPPHILLATGLIHPSVAWRSGSETPGTSESATPESDKKYSIGLAIGTN
SVGWAVITDEYKVPSKKFKVLGNTDRHSIKKNLIGALLFDSGETAEATRLKRTARRRYTRRKNRIC
YLQEIFSNEMAKVDDSFFHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQLFEENPINASGVDAKAILS
ARLSKSRRLENLIAQLPGEKKNGLFGNLIALSLGLTPNFKSNFDLAEDAKLQLSKDTYDDDLDNLL
AQIGDQYADLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRFAWMTRKSEETITPWNFEE
VVDKGASAQSFIERMTNFDKNLPNEKVLPKHSLLYEYFTVYNELTKVKYVTEGMRKPAFLSGEQK
KAIVDLLFKTNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGIRDKQSGKT
ILDFLKSDGFANRNFMQLIHDDSLTFKEDIQKAQVSGQGDSLHEHIANLAGSPAIKKGILQTVKVV
DELVKVMGRHKPENIVIEMARENQTTQKGQKNSRERMKRIEEGIKELGSQILKEHPVENTQLQNE
KLYLYYLQNGRDMYVDQELDINRLSDYDVDAIVPQSFLKDDSIDNKVLTRSDKNRGKSDNVPSEE -continued

VVKKMKNYWRQLLNAKLITQRKFDNLTKAERGGLSELDKAGFIKRQLVETRQITKHVAQILDSR

MNTKYDENDKLIREVKVITLKSKLVSDFRKDFQFYKVREINNYHHAHDAYLNAVVGTALIKKYPK

LESEFVYGDYKVYDVRKMIAKSEQEIGKATAKYFFYSNIMNFFKTEITLANGEIRKRPLIETNGETG

EIVWDKGRDFATVRKVLSMPQVNIVKKTEVQTGGFSKESILPKRNSDKLIARKKDWDPKKYGGFD

SPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYL

DEIIEQISEFSKRVILADANLDKVLSAYNKHRDKPIREQAENIIHLFTLTNLGAPAAFKYFDTTIDRK

RYTSTKEVLDATLIHQSITGLYETRIDLSQLGGDSGGSPKKKRKV rAPOBEC1-XTEN-dCas9-UGI-NLS (SEQ ID NO: 306)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCHLGLPPCLNILRRKQPQ

LTFFTIALQSCHYQRLPPHILWATGLKSGSETPGTSESATPESDKKYSIGLAIGTNSVGWAVITDEYK

VPSKKFKVLGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAKAILSARLSKSRRLENL

IAQLPGEKKNGLFGNLIALSLGLTPNFKSNFDLAEDAKLQLSKDTYDDDLDNLLAQIGDQYADLFL

AAKNLSDAILLSDILRVNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGSIPHQIHLGELHAILRR

QEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFAN

RNFMQLIHDDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYLYYLQNGRD

MYVDQELDINRLSDYDVDAIVPQSFLKDDSIDNKVLTRSDKNRGKSDNVPSEEVVKKMKNYWRQ

LLNAKLITQRKFDNLTKAERGGLSELDKAGFIKRQLVETRQITKHVAQILDSRMNTKYDENDKLIR

EVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATV

RKVLSMPQVNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIEQISEFSKRVIL

ADANLDKVLSAYNKHRDKPIREQAENIIHLFTLTNLGAPAAFKYFDTTIDRKRYTSTKEVLDATLIH

QSITGLYETRIDLSQLGGDSGGSTNLSDHEKETGKQLVIQESILMLPEEVEEVIGNKPESDILVHTAY

DESTDENVMLLTSDAPEYKPWALVIQDSNGENKIKMLSGGSPKKKRKV rAPOBEC1-XTEN-SpCas9 nickase-UGI-NLS (BE3)

(SEQ ID NO: 307)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCHLGLPPCLNILRRKQPQ

LTFFTIALQSCHYQRLPPHILWATGLKSGSETPGTSESATPESDKKYSIGLAIGTNSVGWAVITDEYK

VPSKKFKVLGNTDRHSIKKNLIGALLFDSGETAEATRLKRTARRRYTRRKNRICYLQEIFSNEMAK

-continued

VDDSFFHRLEESFLVEEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAKAILSARLSKSRRLENL

IAQLPGEKKNGLFGNLIALSLGLTPNFKSNFDLAEDAKLQLSKDTYDDDLDNLLAQIGDQYADLFL

AAKNLSDAILLSDILRVNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGSIPHQIHLGELHAILRR

QEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLK11KDKDFLDNEENEDILEDIVLT1TL

FEDREMIEERLKTYAHLFDDKVMKQLKRRRYTGWGRLSRKLINGIRDKQSGKTILDFLKSDGFAN

RNFMQLIHDDSLTFKEDIQKAQVSGQGDSLHEHIANLAGSPAIKKGILQTVKVVDELVKVMGRHK

PENIVIEMARENQTTQKGQKNSRERMKRIEEGIKELGSQILKEHPVENTQLQNEKLYLYYLQNGRD

MYVDQELDINRLSDYDVDHIVPQSFLKDDSIDNKVLTRSDKNRGKSDNVPSEEVVKKMKNYWRQ

LLNAKLITQRKFDNLTKAERGGLSELDKAGFIKRQLVETRQITKHVAQILDSRMNTKYDENDKLIR

EVKVITLKSKLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWDKGRDFATV

RKVLSMPQVNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDL11KLPKYSLFELENGRKRMLA

SAGELQKGNELALPSKYVNFLYLASHYEKLKGSPEDNEQKQLFVEQHKHYLDE11EQISEFSKRVIL

ADANLDKVLSAYNKHRDKPIREQAEN11HLFTLTNLGAPAAFKYFDTTIDRKRYTSTKEVLDATLIH

QSITGLYETRIDLSQLGGDSGGSTNLSDHEKETGKQLVIQESILMLPEEVEEVIGNKPESDILVHTAY

DESTDENVMLLTSDAPEYKPWALVIQDSNGENKIKMLSGGSPKKKRKV pmCDA1-XTEN-dCas9-UGI (bacteria)

(SEQ ID NO: 308)

MTDAEYVRIHEKLDIYTFKKQFFNNKKSVSHRCYVLFELKRRGERRACFWGYAVNKPQSGTERGI

HAEIFSIRKVEEYLRDNPGQFTINWYSSWSPCADCAEKILEWYNQELRGNGHTLKIWACKLYYEK

NARNQIGLWNLRDNGVGLNVMVSEHYQCCRKIFIQSSHNQLNENRWLEKTLKRAEKRRSELSIMI

QVKILHTTKSPAVSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNRE

KIEKILTFRIPYYVGPLARGNSRFAWMTRKSEETITPWNFEEVVDKGASAQSFIERMTNFDKNLPNE

KVLPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSKLV

-continued

SDFRKDFQFYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKVLSMPQVNI

VKKTEVQTGGFSKESILPKRNSDKLIARKKDWDPKKYGGFDSPTVAYSVLVVAKVEKGKSKKLKS

VKELLGITIMERSSFEKNPIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRID

LSQLGGDSGGSMTNLSDIIEKETGKQLVIQESILMLPEEVEEVIGNKPESDILVHTAYDESTDENVM

LLTSDAPEYKPWALVIQDSNGENKIKML pmCDA1-XTEN-nCas9-UGI-NLS (mammalian construct)

(SEQ ID NO: 309)

MTDAEYVRIHEKLDIYTFKKQFFNNKKSVSHRCYVLFELKRRGERRACFWGYAVNKPQSGTERGI

HAEIFSIRKVEEYLRDNPGQFTINWYSSWSPCADCAEKILEWYNQELRGNGHTLKIWACKLYYEK

NARNQIGLWNLRDNGVGLNVMVSEHYQCCRKIFIQSSHNQLNENRWLEKTLKRAEKRRSELSIMI

QVKILHTTKSPAVSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNRE

KIEKILTFRIPYYVGPLARGNSRFAWMTRKSEETITPWNFEEVVDKGASAQSFIERMTNFDKNLPNE

KVLPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSKLV

SDFRKDFQFYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKVLSMPQVNI

VKKTEVQTGGFSKESILPKRNSDKLIARKKDWDPKKYGGFDSPTVAYSVLVVAKVEKGKSKKLKS

VKELLGITIMERSSFEKNPIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRID

LSQLGGDSGGSTNLSDIIEKETGKQLVIQESILMLPEEVEEVIGNKPESDILVHTAYDESTDENVMLL

TSDAPEYKPWALVIQDSNGENKIKMLSGGSPKKKRKV huAPOBEC3G-XTEN-dCas9-UGI (bacteria)

(SEQ ID NO: 310)

MDPPTFTFNFNNEPWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCIFTARIYDDQGRCQEGL

RTLAEAGAKISIMTYSEFKHCWDTFVDHQGCPFQPWDGLDEHSQDLSGRLRAILQSGSETPGTSES

ATPESDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVDEVAY

-continued

HEKYPTIYHLRKKLVDSTDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYVGPLARGNSR

FAWMTRKSEETITPWNFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYT

GWGRLSRKLINGIRDKQSGKTILDFLKSDGFANRNFMQLIHDDSLTFKEDIQKAQVSGQGDSLHEH

IANLAGSPAIKKGILQTVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVDAIVPQSFLKDDSIDN

KVLTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLASHYEKLKG

SPEDNEQKQLFVEQHKHYLDEIIEQISEFSKRVILADANLDKVLSAYNKHRDKPIREQAENIIHLFTL

TNLGAPAAFKYFDTTIDRKRYTSTKEVLDATLIHQSITGLYETRIDLSQLGGDSGGSMTNLSDIIEKE

TGKQLVIQESILMLPEEVEEVIGNKPESDILVHTAYDESTDENVMLLTSDAPEYKPWALVIQDSNGE

NKIKML huAPOBEC3G-XTEN-nCas9-UGI-NLS (mammalian construct)

(SEQ ID NO: 311)

MDPPTFTFNFNNEPWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCIFTARIYDDQGRCQEGL

RTLAEAGAKISIMTYSEFKHCWDTFVDHQGCPFQPWDGLDEHSQDLSGRLRAILQSGSETPGTSES

ATPESDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYVGPLARGNSR

FAWMTRKSEETITPWNFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYT

GWGRLSRKLINGIRDKQSGKTILDFLKSDGFANRNFMQLIHDDSLTFKEDIQKAQVSGQGDSLHEH

IANLAGSPAIKKGILQTVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINNYHHA

-continued

HDAYLNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLASHYEKLKG

SPEDNEQKQLFVEQHKHYLDEIIEQISEFSKRVILADANLDKVLSAYNKHRDKPIREQAENIIHLFTL

TNLGAPAAFKYFDTTIDRKRYTSTKEVLDATLIHQSITGLYETRIDLSQLGGDSGGSTNLSDIIEKET

GKQLVIQESILMLPEEVEEVIGNKPESDILVHTAYDESTDENVMLLTSDAPEYKPWALVIQDSNGE

NKIKMLSGGSPKKKRKV huAPOBEC3G (D316R_D317R)-XTEN-nCas9-UGI-NLS (mammalian construct)

(SEQ ID NO: 312)

MDPPTFTFNFNNEPWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCIFTARIYRRQGRCQEGL

RTLAEAGAKISIMTYSEFKHCWDTFVDHQGCPFQPWDGLDEHSQDLSGRLRAILQSGSETPGTSES

ATPESDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYVGPLARGNSR

FAWMTRKSEETITPWNFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECFDSVEISGVEDRFNASL

GTYHDLLKIIKDKDFLDNEENEDILEDIVLTLTLFEDREMIEERLKTYAHLFDDKVMKQLKRRRYT

GWGRLSRKLINGIRDKQSGKTILDFLKSDGFANRNFMQLIHDDSLTFKEDIQKAQVSGQGDSLHEH

IANLAGSPAIKKGILQTVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLASHYEKLKG

SPEDNEQKQLFVEQHKHYLDEIIEQISEFSKRVILADANLDKVLSAYNKHRDKPIREQAENIIHLFTL

TNLGAPAAFKYFDTTIDRKRYTSTKEVLDATLIHQSITGLYETRIDLSQLGGDSGGSTNLSDIIEKET

GKQLVIQESILMLPEEVEEVIGNKPESDILVHTAYDESTDENVMLLTSDAPEYKPWALVIQDSNGE

NKIKMLSGGSPKKKRKV

High fidelity nucleobase editor (SEQ ID NO: 313)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESDKKYSIGLAIGTNSVGWAVITDEY

KVPSKKFKVLGNTDRHSIKKNLIGALLFDSGETAEATRLKRTARRRYTRRKNRICYLQEIFSNEMA

-continued

KVDDSFFHRLEESFLVEEDKKHERHPIFGNIVDEVAYHEKYPTIYHLRKKLVDSTDKADLRLIYLA

LAHMIKFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLGELHAILR

RQEDFYPFLKDNREKIEKILTFRIPYYVGPLARGNSRFAWMTRKSEETITPWNFEEVVDKGASAQS

FIERMTAFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLT

LTLFEDREMIEERLKTYAHLFDDKVMKQLKRRRYTGWGALSRKLINGIRDKQSGKTILDFLKSDG

FANRNFMALIHDDSLTFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVENTQLQNEKLYLYYLQN

GRDMYVDQELDINRLSDYDVDHIVPQSFLKDDSIDNKVLTRSDKNRGKSDNVPSEEVVKKMKNY

WRQLLNAKLITQRKFDNLTKAERGGLSELDKAGFIKRQLVETRAITKHVAQILDSRMNTKYDEND

KLIREVKVITLKSKLVSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDPKKYGGFDSPTVAYSV

LVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYFDTTIDRKRYTSTKEVL

DATLIHQSITGLYETRIDLSQLGGD

*rAPOBEC1-XTEN-SaCas9n-UGI-NLS) (SaBE3 and SaBE3.9max)*

(SEQ ID NO: 399)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESKRNYILGLDIGITSVGYGIIDYETR

DVIDAGVRLFKEANVENNEGRRSKRGARRLKRRRRHRIQRVKKLLFDYNLLTDHSELSGINPYEA

RVKGLSQKLSEEEFSAALLHLAKRRGVHNVNEVEEDTGNELSTKEQISRNSKALEEKYVAELQLE

RLKKDGEVRGSINRFKTSDYVKEAKQLLKVQKAYHQLDQSFIDTYIDLLETRRTYYEGPGEGSPFG

WKDIKEWYEMLMGHCTYFPEELRSVKYAYNADLYNALNDLNNLVITRDENEKLEYYEKFQIIEN

VFKQKKKPTLKQIAKEILVNEEDIKGYRVTSTGKPEFTNLKVYHDIKDITARKEIIENAELLDQIAKI

LTIYQSSEDIQEELTNLNSELTQEEIEQISNLKGYTGTHNLSLKAINLILDELWHTNDNQIAIFNRLKL

VPKKVDLSQQKEIPTTLVDDFILSPVVKRSFIQSIKVINAIIKKYGLPNDIIIELAREKNSKDAQKMIN

EMQKRNRQTNERIEEIIRTTGKENAKYLIEKIKLHDMQEGKCLYSLEAIPLEDLLNNPFNYEVDHIIP

RSVSFDNSFNNKVLVKQEEASKKGNRTPFQYLSSSDSKISYETFKKHILNLAKGKGRISKTKKEYLL

EERDINRFSVQKDFINRNLVDTRYATRGLMNLLRSYFRVNNLDVKVKSINGGFTSFLRRKWKFKK

ERNKGYKHHAEDALIIANADFIFKEWKKLDKAKKVMENQMFEEKQAESMPEIETEQEYKEIFITPH

QIKHIKDFKDYKYSHRVDKKPNRELINDTLYSTRKDDKGNTLIVNNLNGLYDKDNDKLKKLINKS

PEKLLMYHHDPQTYQKLKLIMEQYGDEKNPLYKYYEETGNYLTKYSKKDNGPVIKKIKYYGNKL

NAHLDITDDYPNSRNKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITYREYLENMNDKRPPRIIKTI

-continued

ASKTQSIKKYSTDILGNLYEVKSKKHPQIIKKGSGGSTNLSDIIEKETGKQLVIQESILMLPEEVEEVI

GNKPESDILVHTAYDESTDENVMLLTSDAPEYKPWALVIQDSNGENKIKMLSGGSPKKKRKV rAPOBEC1-XTEN-SaCas9n-UGI-NLS (SEQ ID NO: 400)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESKRNYILGLDIGITSVGYGIIDYETR

DVIDAGVRLFKEANVENNEGRRSKRGARRLKRRRRHRIQRVKKLLFDYNLLTDHSELSGINPYEA

RVKGLSQKLSEEEFSAALLHLAKRRGVHNVNEVEEDTGNELSTKEQISRNSKALEEKYVAELQLE

RLKKDGEVRGSINRFKTSDYVKEAKQLLKVQKAYHQLDQSFIDTYIDLLETRRTYYEGPGEGSPFG

WKDIKEWYEMLMGHCTYFPEELRSVKYAYNADLYNALNDLNNLVITRDENEKLEYYEKFQIIEN

VFKQKKKPTLKQIAKEILVNEEDIKGYRVTSTGKPEFTNLKVYHDIKDITARKEIIENAELLDQIAKI

LTIYQSSEDIQEELTNLNSELTQEEIEQISNLKGYTGTHNLSLKAINLILDELWHTNDNQIAIFNRLKL

VPKKVDLSQQKEIPTTLVDDFILSPVVKRSFIQSIKVINAIIKKYGLPNDIIIELAREKNSKDAQKMIN

EMQKRNRQTNERIEEIIRTTGKENAKYLIEKIKLHDMQEGKCLYSLEAIPLEDLLNNPFNYEVDHIIP

RSVSFDNSFNNKVLVKQEEASKKGNRTPFQYLSSSDSKISYETFKKHILNLAKGKGRISKTKKEYLL

EERDINRFSVQKDFINRNLVDTRYATRGLMNLLRSYFRVNNLDVKVKSINGGFTSFLRRKWKFKK

ERNKGYKHHAEDALIIANADFIFKEWKKLDKAKKVMENQMFEEKQAESMPEIETEQEYKEIFITPH

QIKHIKDFKDYKYSHRVDKKPNRKLINDTLYSTRKDDKGNTLIVNNLNGLYDKDNDKLKKLINKS

PEKLLMYHHDPQTYQKLKLIMEQYGDEKNPLYKYYEETGNYLTKYSKKDNGPVIKKIKYYGNKL

NAHLDITDDYPNSRNKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITYREYLENMNDKRPPHIIKTI

ASKTQSIKKYSTDILGNLYEVKSKKHPQIIKKGSGGSTNLSDIIEKETGKQLVIQESILMLPEEVEEVI

GNKPESDILVHTAYDESTDENVMLLTSDAPEYKPWALVIQDSNGENKIKMLSGGSPKKKRKV

Nucleobase Editor 4-SSB (SEQ ID NO: 401)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESDKKYSIGLAIGTNSVGWAVITDEY

KVPSKKFKVLGNTDRHSIKKNLIGALLFDSGETAEATRLKRTARRRYTRRKNRICYLQEIFSNEMA

KVDDSFFHRLEESFLVEEDKKHERHPIFGNIVDEVAYHEKYPTIYHLRKKLVDSTDKADLRLIYLA

LAHMIKFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLGELHAILR

RQEDFYPFLKDNREKIEKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLT

LTLFEDREMIEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVDELVKVMGR

HKPENIVIEMARENQTTQKGQKNSRERMKRIEEGIKELGSQILKEHPVENTQLQNEKLYLYYLQNG

-continued

RDMYVDQELDINRLSDYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVAQILDSRMNTKYDENDK
LIREVKVITLKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKKYGGFDSPTVAYSVLV
VAKVEKGKSKKLKSVKELLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQHKHYLDEIIEQISEFSK
RVILADANLDKVLSAYNKHRDKPIREQAENIIHLFTLTNLGAPAAFKYFDTTIDRKRYTSTKEVLD
ATLIHQSITGLYETRIDLSQLGGDSGGSGGSGGSASRGVNKVILVGNLGQDPEVRYMPNGGAVANI
TLATSESWRDKATGEMKEQTEWHRVVLFGKLAEVASEYLRKGSQVYIEGQLRTRKWTDQSGQD
RYTTEVVVNVGGTMQMLGGRQGGGAPAGGNIGGGQPQGGWGQPQQPQGGNQFSGGAQSRPQQ
SAPAAPSNEPPMDFDDDIPFSGGSPKKKRKV

Nucleobase Editor 4-$(GGS)_3$ (SEQ ID NO: 402)

MSSETGPVAVDPTLRRRIEPHEFEVFFDPRELRKETCLLYEINWGGRHSIWRHTSQNTNKHVEVNFI
EKFTTERYFCPNTRCSITWFLSWSPCGECSRAITEFLSRYPHVTLFIYIARLYHHADPRNRQGLRDLI
SSGVTIQIMTEQESGYCWRNFVNYSPSNEAHWPRYPHLWVRLYVLELYCIILGLPPCLNILRRKQP
QLTFFTIALQSCHYQRLPPHILWATGLKSGSETPGTSESATPESDKKYSIGLAIGTNSVGWAVITDEY
KVPSKKFKVLGNTDRHSIKKNLIGALLFDSGETAEATRLKRTARRRYTRRKNRICYLQEIFSNEMA
KVDDSFFHRLEESFLVEEDKKHERHPIFGNIVDEVAYHEKYPTIYHLRKKLVDSTDKADLRLIYLA
LAHMIKFRGHFLIEGDLNPDNSDVDKLFIQLVQTYNQLFEENPINASGVDAKAILSARLSKSRRLEN
LIAQLPGEKKNGLFGNLIALSLGLTPNFKSNFDLAEDAKLQLSKDTYDDDLDNLLAQIGDQYADLF
LAAKNLSDAILLSDILRVNTEITKAPLSASMIKRYDEHHQDLTLLKALVRQQLPEKYKEIFFDQSKN
GYAGYIDGGASQEEFYKFIKPILEKMDGTEELLVKLNREDLLRKQRTFDNGSIPHQIHLGELHAILR
RQEDFYPFLKDNREKIEKILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAFLSGEQKKAIVDLLFKT
NRKVTVKQLKEDYFKKIECFDSVEISGVEDRFNASLGTYHDLLKIIKDKDFLDNEENEDILEDIVLT
LTLFEDREMIEERLKTYAHLFDDKVMKQLKRRRYTGWGRLSRKLINGIRDKQSGKTILDFLKSDGF
ANRNFMQLIHDDSLTFKEDIQKAQVSGQGDSLHEHIANLAGSPAIKKGILQTVKVVDELVKVMGR
HKPENIVIEMARENQTTQKGQKNSRERMKRIEEGIKELGSQILKEHPVENTQLQNEKLYLYYLQNG
RDMYVDQELDINRLSDYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVAQILDSRMNTKYDENDK
LIREVKVITLKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKKYGGFDSPTVAYSVLV
VAKVEKGKSKKLKSVKELLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQHKHYLDEIIEQISEFSK
RVILADANLDKVLSAYNKHRDKPIREQAENIIHLFTLTNLGAPAAFKYFDTTIDRKRYTSTKEVLD
ATLIHQSITGLYETRIDLSQLGGDSGGSGGSGGSTNLSDIIEKETGKQLVIQESILMLPEEVEEVIGNK
PESDILVHTAYDESTDENVMLLTSDAPEYKPWALVIQDSNGENKIKMLSGGSPKKKRKV

-continued

Nucleobase Editor 4-XTEN (SEQ ID NO: 403)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESDKKYSIGLAIGTNSVGWAVITDEY

KVPSKKFKVLGNTDRHSIKKNLIGALLFDSGETAEATRLKRTARRRYTRRKNRICYLQEIFSNEMA

KVDDSFFHRLEESFLVEEDKKHERHPIFGNIVDEVAYHEKYPTIYHLRKKLVDSTDKADLRLIYLA

LAHMIKFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLGELHAILR

RQEDFYPFLKDNREKIEKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLT

LTLFEDREMIEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVDELVKVMGR

HKPENIVIEMARENQTTQKGQKNSRERMKRIEEGIKELGSQILKEHPVENTQLQNEKLYLYYLQNG

RDMYVDQELDINRLSDYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSPTVAYSVLV

VAKVEKGKSKKLKSVKELLGITIMERSSFEKNPIDFLEAKGYKEVKKDLIIKLPKYSLFELENGRKR

MLASAGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTKEVLD

ATLIHQSITGLYETRIDLSQLGGDSGSETPGTSESATPESTNLSDIIEKETGKQLVIQESILMLPEEVEE

VIGNKPESDILVHTAYDESTDENVMLLTSDAPEYKPWALVIQDSNGENKIKMLSGGSPKKKRKV

Nucleobase Editor 4-32 aa linker (SEQ ID NO: 404)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGGSSGGSSGSETPGTSESATPESSGGSSGGSDKKYSIGL

AIGTNSVGWAVITDEYKVPSKKFKVLGNTDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDL

DNLLAQIGDQYADLFLAAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITP

WNFEEVVDKGASAQSFIERMTNFDKNLPNEKVLPKHSLLYEYFTVYNELTKVKYVTEGMRKPAF

-continued

LSGEQKKAIVDLLFKTNRKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKHVA

QILDSRMNTKYDENDKLIREVKVITLKSKLVSDFRKDFQFYKVREINNYHHAHDAYLNAVVGTAL

IKKYPKLESEFVYGDYKVYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLII

KLPKYSLFELENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGSTNLSDIIEKETGKQLVIQESILMLPE

EVEEVIGNKPESDILVHTAYDESTDENVMLLTSDAPEYKPWALVIQDSNGENKIKMLSGGSPKKKR

KV

Nucleobase Editor 4-2X UGI (SEQ ID NO: 405)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGSETPGTSESATPESDKKYSIGLAIGTNSVGWAVITDEY

KVPSKKFKVLGNTDRHSIKKNLIGALLFDSGETAEATRLKRTARRRYTRRKNRICYLQEIFSNEMA

KVDDSFFHRLEESFLVEEDKKHERHPIFGNIVDEVAYHEKYPTIYHLRKKLVDSTDKADLRLIYLA

LAHMIKFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLGELHAILR

RQEDFYPFLKDNREKIEKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLT

LTLFEDREMIEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVDELVKVMGR

HKPENIVIEMARENQTTQKGQKNSRERMKRIEEGIKELGSQILKEHPVENTQLQNEKLYLYYLQNG

RDMYVDQELDINRLSDYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSPTVAYSVLV

VAKVEKGKSKKLKSVKELLGITIMERSSFEKNPIDFLEAKGYKEVKKDLIIKLPKYSLFELENGRKR

MLASAGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYFDTTIDRKRYTSTKEVLD

ATLIHQSITGLYETRIDLSQLGGDSGGSTNLSDIIEKETGKQLVIQESILMLPEEVEEVIGNKPESDILV

-continued

HTAYDESTDENVMLLTSDAPEYKPWALVIQDSNGENKIKMLSGGSTNLSDIIEKETGKQLVIQESIL

MLPEEVEEVIGNKPESDILVHTAYDESTDENVMLLTSDAPEYKPWALVIQDSNGENKIKMLSGGSP

KKKRKV

Nucleobase Editor 4 (BE4)

(SEQ ID NO: 406)

MSSETGPVAVDPTLRRRIEPHEFEVFFDPRELRKETCLLYEINWGGRHSIWRHTSQNTNKHVEVNFI

EKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQP

QLTFFTIALQSCHYQRLPPHILWATGLKSGGSSGGSSGSETPGTSESATPESSGGSSGGSDKKYSIGL

AIGTNSVGWAVITDEYKVPSKKFKVLGNTDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLSKDTYDDDL

DNLLAQIGDQYADLFLAAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITP

WNFEEVVDKGASAQSFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKHVA

QILDSRMNTKYDENDKLIREVKVITLKSKLVSDFRKDFQFYKVREINNYHHAHDAYLNAVVGTAL

IKKYPKLESEFVYGDYKVYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLII

KLPKYSLFELENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGSGGSGGSTNLSDIIEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSPKKKRKV

BE4max (also AncBE4max)

(SEQ ID NO: 482)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSWSPCGECSRAITEFLSRYPHVTLFIYI

ARLYHHADPRNRQGLRDLISSGVTIQIMTEQESGYCWRNFVNYSPSNEAHWPRYPHLWVRLYVLE

LYCIILGLPPCLNILRRKQPQLTFFTIALQSCHYQRLPPHILWATGLKSGGSSGGSSGSETPGTSESAT

PESSGGSSGGSDKKYSIGLAIGTNSVGWAVITDEYKVPSKKFKVLGNTDRHSIKKNLIGALLFDSGE

TAEATRLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFIQLVQ

-continued

TYNQLFEENPINASGVDAKAILSARLSKSRRLENLIAQLPGEKKNGLFGNLIALSLGLTPNFKSNFD

LAEDAKLQLSKDTYDDDLDNLLAQIGDQYADLFLAAKNLSDAILLSDILRVNTEITKAPLSASMIK

RYDEHHQDLTLLKALVRQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLLYEYFTVYN

ELTKVKYVTEGMRKPAFLSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMKRIE

EGIKELGSQILKEHPVENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNIMN

FFKTEITLANGEIRKRPLIETNGETGEIVWDKGRDFATVRKVLSMPQVNIVKKTEVQTGGFSKESIL

PKRNSDKLIARKKDWDPKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDKPIREQAENI

IHLFTLTNLGAPAAFKYFDTTIDRKRYTSTKEVLDATLIHQSITGLYETRIDLSQLGGDSGGSGGSG

GSTNLSDIIEKETGKQLVIQESILMLPEEVEEVIGNKPESDILVHTAYDESTDENVMLLTSDAPEYKP

WALVIQDSNGENKIKMLSGGSGGSGGSTNLSDIIEKETGKQLVIQESILMLPEEVEEVIGNKPESDIL

VHTAYDESTDENVMLLTSDAPEYKPWALVIQDSNGENKIKMLSGGSKRTADGSEFEPKKKRKV

AID-BE4max (SEQ ID NO: 489)

MDSLLMNRRKFLYQFKNVRWAKGRRETYLCYVVKRRDSATSFSLDFGYLRNKNGCHVELLFLR

YISDWDLDPGRCYRVTWFTSWSPCYDCARHVADFLRGNPNLSLRIFTARLYFCEDRKAEPEGLRR

LHRAGVQIAIMTFKDYFYCWNTFVENHERTFKAWEGLHENSVRLSRQLRRILLPLYEVDDLRDAF

RTLGLSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSF

FHRLEESFLVEEDKKHERHPIFGNIVDEVAYHEKYPTIYHLRKKLVDSTDKADLRLIYLALAHMIKF

RGHFLIEGDLNPDNSDVDKLFIQLVQTYNQLFEENPINASGVDAKAILSARLSKSRRLENLIAQLPG

EKKNGLFGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYAGYI

DGGASQEEFYKFIKPILEKMDGTEELLVKLNREDLLRKQRTFDNGSIPHQIHLGELHAILRRQEDFY

PFLKDNREKIEKILTFRIPYYVGPLARGNSRFAWMTRKSEETITPWNFEEVVDKGASAQSFIERMTN

FDKNLPNEKVLPKHSLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENEDILEDIVLTLTLFEDRE

MIEERLKTYAHLFDDKVMKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQ

ELDINRLSDYDVDHIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVKVI

TLKSKLVSDFRKDFQFYKVREINNYHHAHDAYLNAVVGTALIKKYPKLESEFVYGDYKVYDVRK

-continued

MIAKSEQEIGKATAKYFFYSNIMNFFKTEITLANGEIRKRPLIETNGETGEIVWDKGRDFATVRKVL
SMPQVNIVKKTEVQTGGFSKESILPKRNSDKLIARKKDWDPKKYGGFDSPTVAYSVLVVAKVEKG
KSKKLKSVKELLGITIMERSSFEKNPIDFLEAKGYKEVKKDLIIKLPKYSLFELENGRKRMLASAGE
LQKGNELALPSKYVNFLYLASHYEKLKGSPEDNEQKQLFVEQHKHYLDEIIEQISEFSKRVILADA
NLDKVLSAYNKHRDKPIREQAENIIHLFTLTNLGAPAAFKYFDTTIDRKRYTSTKEVLDATLIHQSI
TGLYETRIDLSQLGGDSGGSGGSGGSTNLSDIIEKETGKQLVIQESILMLPEEVEEVIGNKPESDILV
HTAYDESTDENVMLLTSDAPEYKPWALVIQDSNGENKIKMLSGGSGGSGGSTNLSDIIEKETGKQL
VIQESILMLPEEVEEVIGNKPESDILVHTAYDESTDENVMLLTSDAPEYKPWALVIQDSNGENKIKM
LSGGSPKKKRKV

AID-VRQR-BE4max (SEQ ID NO: 490)

MDSLLMNRRKFLYQFKNVRWAKGRRETYLCYVVKRRDSATSFSLDFGYLRNKNGCHVELLFLR
YISDWDLDPGRCYRVTWFTSWSPCYDCARHVADFLRGNPNLSLRIFTARLYFCEDRKAEPEGLRR
LHRAGVQIAIMTFKDYFYCWNTFVENHERTFKAWEGLHENSVRLSRQLRRILLPLYEVDDLRDAF
RTLGLSGGSSGGSSGSETPGTSESATPESSGGSSGGSDKKYSIGLAIGTNSVGWAVITDEYKVPSKK
FKVLGNTDRHSIKKNLIGALLFDSGETAEATRLKRTARRRYTRRKNRICYLQEIFSNEMAKVDDSF
FHRLEESFLVEEDKKHERHPIFGNIVDEVAYHEKYPTIYHLRKKLVDSTDKADLRLIYLALAHMIKF
RGHFLIEGDLNPDNSDVDKLFIQLVQTYNQLFEENPINASGVDAKAILSARLSKSRRLENLIAQLPG
EKKNGLFGNLIALSLGLTPNFKSNFDLAEDAKLQLSKDTYDDDLDNLLAQIGDQYADLFLAAKNL
SDAILLSDILRVNTEITKAPLSASMIKRYDEHHQDLTLLKALVRQQLPEKYKEIFFDQSKNGYAGYI
DGGASQEEFYKFIKPILEKMDGTEELLVKLNREDLLRKQRTFDNGSIPHQIHLGELHAILRRQEDFY
PFLKDNREKIEKILTFRIPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEENEDILEDIVLTLTLFEDRE
MIEERLKTYAHLFDDKVMKQLKRRRYTGWGRLSRKLINGIRDKQSGKTILDFLKSDGFANRNFMQ
LIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQ
ELDINRLSDYDVDHIVPQSFLKDDSIDNKVLTRSDKNRGKSDNVPSEEVVKKMKNYWRQLLNAK
LITQRKFDNLTKAERGGLSELDKAGFIKRQLVETRQITKHVAQILDSRMNTKYDENDKLIREVKVI
TLKSKLVSDFRKDFQFYKVREINNYHHAHDAYLNAVVGTALIKKYPKLESEFVYGDYKVYDVRK
MIAKSEQEIGKATAKYFFYSNIMNFFKTEITLANGEIRKRPLIETNGETGEIVWDKGRDFATVRKVL
SMPQVNIVKKTEVQTGGFSKESILPKRNSDKLIARKKDWDPKKYGGFVSPTVAYSVLVVAKVEKG
KSKKLKSVKELLGITIMERSSFEKNPIDFLEAKGYKEVKKDLIIKLPKYSLFELENGRKRMLASARE
LQKGNELALPSKYVNFLYLASHYEKLKGSPEDNEQKQLFVEQHKHYLDEIIEQISEFSKRVILADA
NLDKVLSAYNKHRDKPIREQAENIIHLFTLTNLGAPAAFKYFDTTIDRKQYRSTKEVLDATLIHQSI
TGLYETRIDLSQLGGDSGGSGGSGGSTNLSDIIEKETGKQLVIQESILMLPEEVEEVIGNKPESDILV
HTAYDESTDENVMLLTSDAPEYKPWALVIQDSNGENKIKMLSGGSGGSGGSTNLSDIIEKETGKQL
VIQESILMLPEEVEEVIGNKPESDILVHTAYDESTDENVMLLTSDAPEYKPWALVIQDSNGENKIKM
LSGGSKRTADGSEFEPKKKRKV

-continued

AncBE4max 689

(SEQ ID NO: 515)

MKRTADGSEFESPKKKRKVSSETGPVAVDPTLRRRIEPHEFEVFFDPRELRKETCLLYEIKWG

TSHKIWRHSSKNTTKHVEVNFIEKFTSERHFCPSTSCSITWFLSWSPCGECSKAITEFLSQHPN

VTLVIYVARLYHHMDQQNRQGLRDLVNSGVTIQIMTAPEYDYCWRNFVNYPPGKEAHWPR

YPPLWMKLYALELHAGILGLPPCLNILRRKQPQLTFFTIALQSCHYQRLPPHILWATGLKSG

GSSGGSSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMIKFRGHFLIE

GDLNPDNSDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFLKDNR

EKIEKILTFRIPYYVGPLARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSKLV

SDFRKDFQFYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKVLSMPQVNI

VKKTEVQTGGFSKESILPKRNSDKLIARKKDWDPKKYGGFDSPTVAYSVLVVAKVEKGKSKKLKS

VKELLGITIMERSSFEKNPIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRID

LSQLGGDSGGSGGSGGSTNLSDIIEKETGKQLVIQESILMLPEEVEEVIGNKPESDILVHTAYDESTD

ENVMLLTSDAPEYKPWALVIQDSNGENKIKMLSGGSGGSGGSTNLSDIIEKETGKQLVIQESILMLP

EEVEEVIGNKPESDILVHTAYDESTDENVMLLTSDAPEYKPWALVIQDSNGENKIKMLSGGSKRTA

DGSEFEPKKKRKV

YE1-BE4

(SEQ ID NO: 516)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSYSPCGECSRAITEFLSRYPHVTLFIYIA

RLYHHADPENRQGLRDLISSGVTIQIMTEQESGYCWRNFVNYSPSNEAHWPRYPHLWVRLYVLEL

YCIILGLPPCLNILRRKQPQLTFFTIALQSCHYQRLPPHILWATGLKSGGSSGGSSGSETPGTSESATP

ESSGGSSGGS*DKKYSIGLAIGTNSVGWAVITDEYKVPSKKFKVLGNTDRHSIKKNLIGALLFDSGETAEAT*

*RLKRTARRRYTRRKNRICYLQEIFSNEMAKVDDSFFHRLEESFLVEEDKKHERHPIFGNIVDEVAYHEKY*

*PTIYHLRKKLVDSTDICADLRLIYLALAHMIKFRGHFLIEGDLNPDNSDVDKLFIQLVQTYNQLFEENPINA*

*SGVDAKAILSARLSKSRRLENLIAQLPGEKKNGLFGNLIALSLGLTPNFKSNFDLAEDAKLQLSKDTYDDD*

*LDNLLAQIGDQYADLFLAAKNLSDAILLSDILRVNTEITKAPLSASMIKRYDEHHQDLTLLKALVRQQLPE*

-continued

*KYKEIFFDQSKNGYAGYIDGGASQEEFYKFIKPILEKMDGTEELLVKLNREDLLRKQRTFDNGSIPHQIH*

*LGELHAILRRQEDFYPFLKDNREKIEKILTFRIPYYVGPLARGNSRFAWMTRKSEETITPWNFEEVVDKGA*

*SAQSFIERMTNFDKNLPNEKVLPKHSLLYEYFTVYNELTKVKYVTEGMRKPAFLSGEQKKAIVDLLFKTN*

*RKVTVKQLKEDYFKKIECFDSVEISGVEDRFNASLGTYHDLLKIIKDKDFLDNEENEDILEDIVLTLTLFE*

*DREMIEERLKTYAHLFDDKVMKQLKRRRYTGWGRLSRKLINGIRDKQSGKTILDFLKSDGFANRNFMQL*

*IHDDSLTFKEDIQKAQVSGQGDSLHEHIANLAGSPAIKKGILQTVKVVDELVKVMGRHKPENIVIEMARE*

*NQTTQKGQKNSRERMKRIEEGIKELGSQILKEHPVENTQLQNEKLYLYYLQNGRDMYVDQELDINRLSD*

*YDVDHIVPQSFLKDDSIDNKVLTRSDKNRGKSDNVPSEEVVKKMKNYWRQLLNAKLITQRKFDNLTKAE*

*RGGLSELDKAGFIKRQLVETRQITKHVAQILDSRMNTKYDENDKLIREVKVITLKSKLVSDFRKDFQFYK*

*VREINNYHHAHDAYLNAVVGTALIKKYPKLESEFVYGDYKVYDVRKMIAKSEQEIGKATAKYFFYSNIMN*

*FFKTEITLANGEIRKRPLIETNGETGEIVWDKGRDFATVRKVLSMPQVNIVKKTEVQTGGFSKESILPKRN*

*SDKLIARKKDWDPKKYGGFDSPTVAYSVLVVAKVEKGKSKKLKSVKELLGITIMERSSFEKNPIDFLEAK*

*GYKEVKKDLIIKLPKYSLFELENGRKRMLASAGELQKGNELALPSKYVNFLYLASHYEKLKGSPEDNEQK*

*QLFVEQHKHYLDETIEQISEFSKRVILADANLDKVLSAYNKHRDKPIREQAENIIHLFTLTNLGAPAAFKYF*

*DTTIDRKRYTSTKEVLDATLIHQSITGLYETRIDLSQLGGD*SGGSGGSGGSTNLSDIIEKETGKQLVIQES

ILMLPEEVEEVIGNKPESDILVHTAYDESTDENVMLLTSDAPEYKPWALVIQDSNGENKIKMLSGG

SGGSGGSTNLSDIIEKETGKQLVIQESILMLPEEVEEVIGNKPESDILVHTAYDESTDENVMLLTSDA

PEYKPWALVIQDSNGENKIKMLSGGSKRTADGSEFEPKKKRKV

YE2-BE4

(SEQ ID NO: 517)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSYSPCGECSRAITEFLSRYPHVTLFIYIA

RLYHHADPRNRQGLEDLISSGVTIQIMTEQESGYCWRNFVNYSPSNEAHWPRYPHLWVRLYVLEL

YCIILGLPPCLNILRRKQPQLTFFTIALQSCHYQRLPPHILWATGLKSGGSSGGSSGSETPGTSESATP

ESSGGSSGGS*DKKYSIGLAIGTNSVGWAVITDEYKVPSKKFKVLGNTDRHSIKKNLIGALLFDSGETAEAT*

*RLKRTARRRYTRRKNRICYLQEIFSNEMAKVDDSFFHRLEESFLVEEDKKHERHPIFGNIVDEVAYHEKY*

*PTIYHLRKKLVDSTDICADLRLIYLALAHMIKFRGHFLIEGDLNPDNSDVDKLFIQLVQTYNQLFEENPINA*

*SGVDAKAILSARLSKSRRLENLIAQLPGEKKNGLFGNLIALSLGLTPNFKSNFDLAEDAKLQLSKDTYDDD*

*LDNLLAQIGDQYADLFLAAKNLSDAILLSDILRVNTEITKAPLSASMIKRYDEHHQDLTLLKALVRQQLPE*

*KYKEIFFDQSKNGYAGYIDGGASQEEFYKFIKPILEKMDGTEELLVKLNREDLLRKQRTFDNGSIPHQIH*

*LGELHAILRRQEDFYPFLKDNREKIEKILTFRIPYYVGPLARGNSRFAWMTRKSEETITPWNFEEVVDKGA*

*SAQSFIERMTNFDKNLPNEKVLPKHSLLYEYFTVYNELTKVKYVTEGMRKPAFLSGEQKKAIVDLLFKTN*

*RKVTVKQLKEDYFKKIECFDSVEISGVEDRFNASLGTYHDLLKIIKDKDFLDNEENEDILEDIVLTLTLFE*

*DREMIEERLKTYAHLFDDKVMKQLKRRRYTGWGRLSRKLINGIRDKQSGKTILDFLKSDGFANRNFMQL*

*IHDDSLTFKEDIQKAQVSGQGDSLHEHIANLAGSPAIKKGILQTVKVVDELVKVMGRHKPENIVIEMARE*

*NQTTQKGQKNSRERMKRIEEGIKELGSQILKEHPVENTQLQNEKLYLYYLQNGRDMYVDQELDINRLSD*

*YDVDHIVPQSFLKDDSIDNKVLTRSDKNRGKSDNVPSEEVVKKMKNYWRQLLNAKLITQRKFDNLTKAE*

*RGGLSELDKAGFIKRQLVETRQITKHVAQILDSRMNTKYDENDKLIREVKVITLKSKLVSDFRKDFQFYK*

*VREINNYHHAHDAYLNAVVGTALIKKYPKLESEFVYGDYKVYDVRKMIAKSEQEIGKATAKYFFYSNIMN*

*FFKTEITLANGEIRKRPLIETNGETGEIVWDKGRDFATVRICVLSMPQVNIVKKTEVQTGGFSKESILPKRN*

*SDKLIARKKDWDPKKYGGFDSPTVAYSVLVVAKVEKGKSKKLKSVKELLGITIMERSSFEKNPIDFLEAK*

*GYKEVKKDLIIKLPKYSLFELENGRKRMLASAGELQKGNELALPSKYVNFLYLASHYEKLKGSPEDNEQK*

-continued

*QLFVEQHKHYLDEHEQISEFSKRVILADANLDKVLSAYNKHRDKPIREQAENIIHLFTLTNLGAPAAFKYF*

*DTTIDRKRYTSTKEVLDATLIHQSITGLYETRIDLSQLGGDSG*GSGGSGGSTNLSDIIEKETGKQLVIQES

ILMLPEEVEEVIGNKPESDILVHTAYDESTDENVMLLTSDAPEYKPWALVIQDSNGENKIKMLSGG

SGGSGGSTNLSDIIEKETGKQLVIQESILMLPEEVEEVIGNKPESDILVHTAYDESTDENVMLLTSDA

PEYKPWALVIQDSNGENKIKMLSGGSKRTADGSEFEPKKKRKV

YEE-BE4

(SEQ ID NO: 518)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSYSPCGECSRAITEFLSRYPHVTLFIYIA

RLYHHADPENRQGLEDLISSGVTIQIMTEQESGYCWRNFVNYSPSNEAHWPRYPHLWVRLYVLEL

YCIILGLPPCLNILRRKQPQLTFFTIALQSCHYQRLPPHILWATGLKSGGSSGGSSGSETPGTSESATP

ESSGGSSGGS*DKKYSIGLAIGTNSVGWAVITDEYKVPSKKFKVLGNTDRHSIKKNLIGALLFDSGETAEAT*

*RLKRTARRRYTRRKNRICYLQEIFSNEMAKVDDSFFHRLEESFLVEEDKKHERHPIFGNIVDEVAYHEKY*

*PTIYHLRKKLVDSTDICADLRLIYLALAHMIKFRGHFLIEGDLNPDNSDVDKLFIQLVQTYNQLFEENPINA*

*SGVDAKAILSARLSKSRRLENLIAQLPGEKKNGLFGNLIALSLGLTPNFKSNFDLAEDAKLQLSKDTYDDD*

*LDNLLAQIGDQYADLFLAAKNLSDAILLSDILRVNTEITKAPLSASMIKRYDEHHQDLTLLKALVRQQLPE*

*KYKEIFFDQSKNGYAGYIDGGASQEEFYKFIKPILEKMDGTEELLVKLNREDLLRKQRTFDNGSIPHQIH*

*LGELHAILRRQEDFYPFLKDNREKIEKILTFRIPYYVGPLARGNSRFAWMTRKSEETITPWNFEEVVDKGA*

*SAQSFIERMTNFDKNLPNEKVLPKHSLLYEYFTVYNELTKVKYVTEGMRKPAFLSGEQKKAIVDLLFKTN*

*RKVTVKQLKEDYFKKIECFDSVEISGVEDRFNASLGTYHDLLKIIKDKDFLDNEENEDILEDIVLTLTLFE*

*DREMIEERLKTYAHLFDDKVMKQLKRRRYTGWGRLSRKLINGIRDKQSGKTILDFLKSDGFANRNFMQL*

*IHDDSLTFKEDIQKAQVSGQGDSLHEHIANLAGSPAIKKGILQTVKVVDELVKVMGRHKPENIVIEMARE*

*NQTTQKGQKNSRERMKRIEEGIKELGSQILKEHPVENTQLQNEKLYLYYLQNGRDMYVDQELDINRLSD*

*YDVDHIVPQSFLKDDSIDNKVLTRSDKNRGKSDNVPSEEVVKKMKNYWRQLLNAKLITQRKFDNLTKAE*

*RGGLSELDKAGFIKRQLVETRQITKHVAQILDSRMNTKYDENDKLIREVKVITLKSKLVSDFRKDFQFYK*

*VREINNYHHAHDAYLNAVVGTALIKKYPKLESEFVYGDYKVYDVRKMIAKSEQEIGKATAKYFFYSNIMN*

*FFKTEITLANGEIRKRPLIETNGETGEIVWDKGRDFATVRKVLSMPQVNIVKKTEVQTGGFSKESILPKRN*

*SDKLIARKKDWDPKKYGGFDSPTVAYSVLVVAKVEKGKSKKLKSVKELLGITIMERSSFEKNPIDFLEAK*

*GYKEVKKDLIIKLPKYSLFELENGRKRMLASAGELQKGNELALPSKYVNFLYLASHYEKLKGSPEDNEQK*

*QLFVEQHKHYLDEHEQISEFSKRVILADANLDKVLSAYNKHRDKPIREQAENIIHLFTLTNLGAPAAFKYF*

*DTTIDRKRYTSTKEVLDATLIHQSITGLYETRIDLSQLGGDS*GGSGGSGGSTNLSDIIEKETGKQLVIQES

ILMLPEEVEEVIGNKPESDILVHTAYDESTDENVMLLTSDAPEYKPWALVIQDSNGENKIKMLSGG

SGGSGGSTNLSDIIEKETGKQLVIQESILMLPEEVEEVIGNKPESDILVHTAYDESTDENVMLLTSDA

PEYKPWALVIQDSNGENKIKMLSGGSKRTADGSEFEPKKKRKV

EE-BE4

(SEQ ID NO: 550)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSWSPCGECSRAITEFLSRYPHVTLFIYI

ARLYHHADPENRQGLEDLISSGVTIQIMTEQESGYCWRNFVNYSPSNEAHWPRYPHLWVRLYVLE

LYCIILGLPPCLNILRRKQPQLTFFTIALQSCHYQRLPPHILWATGLKSGGSSGGSSGSETPGTSESAT

PESSGGSSGGS*DKKYSIGLAIGTNSVGWAVITDEYKVPSKKFKVLGNTDRHSIKKNLIGALLFDSGETAEA*

*TRLKRTARRRYTRRKNRICYLQEIFSNEMAKVDDSFFHRLEESFLVEEDKKHERHPIFGNIVDEVAYHEK*

-continued

YPTIYHLRKKLVDSTDKADLRLIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNFKSNFDLAEDAKLQLSKDTYDD

DLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKKAIVDLLFK

TNRINTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFM

QLIHDDSLTFKEDIQICAQVSGQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKSKLVSDFRKDFQF

YKVREINNYHHAHDAYLNAVVGTALIKKYPKLESEFVYGDYKVYDVRKMIAKSEQEIGKATAKYFFYSNIM

NFFKTEITLANGEIRKRPLIETNGETGEIVWDKGRDFATVRKVLSMPQVNIVKKTEVQTGGFSKESILPKR

NSDKLIARKKDWDPKKYGGFDSPTVAYSVLVVAKVEKGKSKKLKSVKELLGITIMERSSFEKNPIDFLEA

KGYKEVKKDLIIKLPKYSLFELENGRKRMLASAGELQKGNELALPSKYVNFLYLASHYEKLKGSPEDNEQ

KQLFVEQHKHYLDEHEQISEFSKRVILADANLDKVLSAYNKHRDKPIREQAENIIHLFTLTNLGAPAAFKY

FDTTIDRKRYTSTKEVLDATLIHQSITGLYETRIDLSQLGGDSGGSGGSGGSTNLSDIIEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSKRTADGSEFEPKKKRKV

R33A-BE4

(SEQ ID NO: 551)

MKRTADGSEFESPKKKRKVSSETGPVAVDPTLRRRIEPHEFEVFFDPRELAKETCLLYEINWGGRH

SIWRHTSQNTNKHVEVNFIEKFTTERYFCPNTRCSITWFLSWSPCGECSRAITEFLSRYPHVTLFIYI

ARLYHHADPRNRQGLRDLISSGVTIQIMTEQESGYCWRNFVNYSPSNEAHWPRYPHLWVRLYVLE

LYCIILGLPPCLNILRRKQPQLTFFTIALQSCHYQRLPPHILWATGLKSGGSSGGSSGSETPGTSESAT

PESSGGSSGGSDKKYSIGLAIGTNSVGWAVITDEYKVPSKKFKVLGNTDRHSIKKNLIGALLFDSGETAEA

TRLKRTARRRYTRRKNRICYLQEIFSNEMAKVDDSFFHRLEESFLVEEDKKHERHPIFGNIVDEVAYHEK

YPTIYHLRKKLVDSTDKADLRLIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNFKSNFDLAEDAKLQLSKDTYDD

DLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKKAIVDLLFK

TNRINTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFM

QLIHDDSLTFKEDIQKAQVSGQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKSKLVSDFRKDFQF

-continued

*YKVREINNYHHAHDAYLNAVVGTALIKKYPKLESEFVYGDYKVYDVRKMIAKSEQEIGKATAKYFFYSNIM*

*NFFKTEITLANGEIRKRPLIETNGETGEIVWDKGRDFATVRKVLSMPQVNIVKKTEVQTGGFSKESILPKR*

*NSDKLIARKKDWDPKKYGGFDSPTVAYSVLVVAKVEKGKSKKLKSVKELLGITIMERSSFEKNPIDFLEA*

*KGYKEVKKDLIIKLPKYSLFELENGRKRMLASAGELQKGNELALPSKYVNFLYLASHYEKLKGSPEDNEQ*

*KQLFVEQHKHYLDEHEQISEFSKRVILADANLDKVLSAYNKHRDKPIREQAENIIHLFTLTNLGAPAAFKY*

FDTTIDRKRYTSTKEVLDATLIHQSITGLYETRIDLSQLGGDSGGSGGSGGSTNLSDIIEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSKRTADGSEFEPKKKRKV

R33A + K34A-BE4

(SEQ ID NO: 552)

MKRTADGSEFESPKKKRKVSSETGPVAVDPTLRRRIEPHEFEVFFDPRELAAETCLLYEINWGGRH

SIWRHTSQNTNKHVEVNFIEKFTTERYFCPNTRCSITWFLSWSPCGECSRAITEFLSRYPHVTLFIYI

ARLYHHADPRNRQGLRDLISSGVTIQIMTEQESGYCWRNFVNYSPSNEAHWPRYPHLWVRLYVLE

LYCIILGLPPCLNILRRKQPQLTFFTIALQSCHYQRLPPHILWATGLKSGGSSGGSSGSETPGTSESAT

PESSGGSSGGS*DKKYSIGLAIGTNSVGWAVITDEYKVPSKKFKVLGNTDRHSIKKNLIGALLFDSGETAEA*

*TRLKRTARRRYTRRKNRICYLQEIFSNEMAKVDDSFFHRLEESFLVEEDKKHERHPIFGNIVDEVAYHEK*

*YPTIYHLRKKLVDSTDKADLRLIYLALAHMIKFRGHFLIEGDLNPDNSDVDKLFIQLVQTYNQLFEENPIN*

*ASGVDAKAILSARLSKSRRLENLIAQLPGEKKNGLFGNLIALSLGLTPNFKSNFDLAEDAKLQLSKDTYDD*

*DLDNLLAQIGDQYADLFLAAKNLSDAILLSDILRVNTEITKAPLSASMIKRYDEHHQDLTLLKALVRQQLP*

*EKYKEIFFDQSKNGYAGYIDGGASQEEFYKFIKPILEKMDGTEELLVKLNREDLLRKQRTFDNGSIPHQI*

*HLGELHAILRRQEDFYPFLKDNREKIEKILTFRIPYYVGPLARGNSRFAWMTRKSEETITPWNFEEVVDK*

*GASAQSFIERMTNFDKNLPNEKVLPKHSLLYEYFTVYNELTKVKYVTEGMRKPAFLSGEQKKAIVDLLFK*

*TNRINTVKQLKEDYFKKIECFDSVEISGVEDRFNASLGTYHDLLKIIKDKDFLDNEENEDILEDIVLTLTL*

*FEDREMIEERLKTYAHLFDDKVMKQLKRRRYTGWGRLSRKLINGIRDKQSGKTILDFLKSDGFANRNFM*

*QLIHDDSLTFKEDIQKAQVSGQGDSLHEHIANLAGSPAIKKGILQTVKVVDELVKVMGRHKPENIVIEMA*

*RENQTTQKGQKNSRERMKRIEEGIKELGSQILKEHPVENTQLQNEKLYLYYLQNGRDMYVDQELDINRL*

*SDYDVDHIVPQSFLKDDSIDNKVLTRSDKNRGKSDNVPSEEVVKKMKNYWRQLLNAKLITQRKFDNLTK*

*AERGGLSELDKAGFIKRQLVETRQITKHVAQILDSRMNTKYDENDKLIREVKVITLKSKLVSDFRKDFQF*

*YKVREINNYHHAHDAYLNAVVGTALIKKYPKLESEFVYGDYKVYDVRKMIAKSEQEIGKATAKYFFYSNIM*

*NFFKTEITLANGEIRKRPLIETNGETGEIVWDKGRDFATVRKVLSMPQVNIVKKTEVQTGGFSKESILPKR*

*NSDKLIARKKDWDPKKYGGFDSPTVAYSVLVVAKVEKGKSKKLKSVKELLGITIMERSSFEKNPIDFLEA*

*KGYKEVKKDLIIKLPKYSLFELENGRKRMLASAGELQKGNELALPSKYVNFLYLASHYEKLKGSPEDNEQ*

*KQLFVEQHKHYLDEHEQISEFSKRVILADANLDKVLSAYNKHRDKPIREQAENIIHLFTLTNLGAPAAFKY*

*FDTTIDRKRYTSTKEVLDATLIHQSITGLYETRIDLSQLGGD*SGGSGGSGGSTNLSDIIEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSKRTADGSEFEPKKKRKV

FERNY-BE4

(SEQ ID NO: 362)

MKRTADGSEFESPKKKRKVFERNYDPRELRKETYLLYEIKWGKSGKLWRHWCQNNRTQHAEVY

FLENIFNARRFNPSTHCSITWYLSWSPCAECSQKIVDFLKEHPNVNLEIYVARLYYHEDERNRQGL

RDLVNSGVTIRIMDLPDYNYCWKTFVSDQGGDEDYWPGHFAPWIKQYSLKLSGGSSGGSSGSETP

-continued

GTSESATPESSGGSSGGSDKKYSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEESFLVEEDKKHERHPIFGNIVDE
VAYHEKYPTIYHLRKKLVDSTDKADLRLIYLALAHMIKFRGHFLIEGDLNPDNSDVDKLFIQLVQTYNQL
FEENPINASGVDAKAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRYDEHHQDLTLLKAL
VRQQLPEKYKEIFFDQSKNGYAGYIDGGASQEEFYKFIKPILEKMDGTEELLVKLNREDLLRKQRTFDN
GSIPHQIHLGELHAILRRQEDFYPFLKDNREKIEKILTFRIPYYVGPLARGNSRFAWMTRKSEETITPWNF
EEVVDKGASAQSFIERMTNFDKNLPNEKVLPKHSLLYEYFTVYNELTKVKYVTEGMRKPAFLSGEQKKAI
VDLLFKTNRKVTVKQLKEDYFKKIECFDSVEISGVEDRFNASLGTYHDLLKIIKDKDFLDNEENEDILEDI
VLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPEN
IVIEMARENQTTQKGQKNSRERMKRIEEGIKELGSQILKEHPVENTQLQNEKLYLYYLQNGRDMYVDQE
LDINRLSDYDVDHIVPQSFLKDDSIDNICVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREVKVITLKSKLVSDFR
KDFQFYKVREINNYHHAHDAYLNAVVGTALIKKYPKLESEFVYGDYKVYDVRKMIAKSEQEIGKATAKYF
FYSNIMNFFKTEITLANGEIRKRPLIETNGETGEIVWDKGRDFATVRKVLSMPQVNIVKKTEVQTGGFSK
ESILPKRNSDKLIARKKDWDPKKYGGFDSPTVAYSVLVVAKVEKGKSKKLKSVKELLGITIMERSSFEKNP
IDFLEAKGYKEVKKDLIIKLPKYSLFELENGRKRMLASAGELQKGNELALPSKYVNFLYLASHYEKLKGSP
EDNEQKQLFVEQHKHYLDEHEQISEFSKRVILADANLDKVLSAYNKHRDKPIREQAENIIHLFTLTNLGA
PAAFKYFDTTIDRKRYTSTKEVLDATLIHQSITGLYETRIDLSQLGGDSGGSGGSGGSTNLSDIIEKETGK
QLVIQESILMLPEEVEEVIGNKPESDILVHTAYDESTDENVMLLTSDAPEYKPWALVIQDSNGENKI
KMLSGGSGGSGGSTNLSDIIEKETGKQLVIQESILMLPEEVEEVIGNKPESDILVHTAYDESTDENV
MLLTSDAPEYKPWALVIQDSNGENKIKMLSGGSKRTADGSEFEPKKKRKV

AALN-BE4

(SEQ ID NO: 364)

MKRTADGSEFESPKKKRKVSSETGPVAVDPTLRRRIEPHEFEVFFDPRELAAETCLLYEINWGGRH
SIWRHTSQNTNKHVEVNFIEKFTTERYFCPNTRCSITWFLSWSPCGECSRAITEFLSRYPHVTLFIYI
ARLYHLANPRNRQGLRDLISSGVTIQIMTEQESGYCWRNFVNYSPSNEAHWPRYPHLWVRLYVLE
LYCIILGLPPCLNILRRKQPQLTFFTIALQSCHYQRLPPHILWATGLKSGGSSGGSSGSETPGTSESAT
PESSGGSSGGSDKKYSIGLAIGTNSVGWAVITDEYKVPSKKFKVLGNTDRHSIKKNLIGALLFDSGETAEA
TRLKRTARRRYTRRKNRICYLQEIFSNEMAKVDDSFFHRLEESFLVEEDKKHERHPIFGNIVDEVAYHEK
YPTIYHLRKKLVDSTDKADLRLIYLALAHMIKFRGHFLIEGDLNPDNSDVDKLFIQLVQTYNQLFEENPIN
ASGVDAKAILSARLSKSRRLENLIAQLPGEKKNGLFGNLIALSLGLTPNFKSNFDLAEDAKLQLSKDTYDD
DLDNLLAQIGDQYADLFLAAKNLSDAILLSDILRVNTEITKAPLSASMIKRYDEHHQDLTLLKALVRQQLP
EKYKEIFFDQSKNGYAGYIDGGASQEEFYKFIKPILEKMDGTEELLVKLNREDLLRKQRTFDNGSIPHQI
HLGELHAILRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEENEDILEDIVLTLTL
FEDREMIEERLKTYAHLFDDKVMKQLKRRRYTGWGRLSRKLINGIRDKQSGKTILDFLKSDGFANRNFM
QLIHDDSLTFKEDIQKAQVSGQGDSLHEHIANLAGSPAIKKGILQTVKVVDELVKVMGRHKPENIVIEMA
RENQTTQKGQKNSRERMKRIEEGIKELGSQILKEHPVENTQLQNEKLYLYYLQNGRDMYVDQELDINRL

-continued

*SDYDVDHIVPQSFLKDDSIDNKVLTRSDKNRGKSDNVPSEEVVKKMKNYWRQLLNAKLITQRKFDNLTK*

*AERGGLSELDKAGFIKRQLVETRQITKHVAQILDSRMNTKYDENDKLIREVKVITLKSKLVSDFRKDFQF*

*YKVREINNYHHAHDAYLNAVVGTALIKKYPKLESEFVYGDYKVYDVRKMIAKSEQEIGKATAKYFFYSNIM*

*NFFKTEITLANGEIRKRPLIETNGETGEIVWDKGRDFATVRKVLSMPQVNIVKKTEVQTGGFSKESILPKR*

*NSDKLIARKKDWDPKKYGGFDSPTVAYSVLVVAKVEKGKSKKLKSVKELLGITIMERSSFEKNPIDFLEA*

*KGYKEVKKDLIIKLPKYSLFELENGRKRMLASAGELQKGNELALPSKYVNFLYLASHYEKLKGSPEDNEQ*

*KQLFVEQHKHYLDEHEQISEFSKRVILADANLDKVLSAYNKHRDKPIREQAENIIHLFTLTNLGAPAAFKY*

*FDTTIDRKRYTSTKEVLDATLIHQSITGLYETRIDLSQLGGDS*GGSGGSGGSTNLSDIIEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSKRTADGSEFEPKKKRKV

BE4max, modified with SpCas9-NG ("BE4-NG")

(SEQ ID NO: 365)

MKRTADGSEFESPKKKRKVSSETGPVAVDPTLRRRIEPHEFEVFFDPRELRKETCLLYEINWGGRH

SIWRHTSQNTNKHVEVNFIEKFTTERYFCPNTRCSITWFLSWSPCGECSRAITEFLSRYPHVTLFIYI

ARLYHHADPRNRQGLRDLISSGVTIQIMTEQESGYCWRNFVNYSPSNEAHWPRYPHLWVRLYVLE

LYCIILGLPPCLNILRRKQPQLTFFTIALQSCHYQRLPPHILWATGLKSGGSSGGSSGSETPGTSESAT

PESSGGSSGGS*DKKYSIGLAIGTNSVGWAVITDEYKVPSKKFKVLGNTDRHSIKKNLIGALLFDSGETAEA*

*TRLKRTARRRYTRRKNRICYLQEIFSNEMAKVDDSFFHRLEESFLVEEDKKHERHPIFGNIVDEVAYHEK*

*YPTIYHLRKKLVDSTDKADLRLIYLALAHMIKFRGHFLIEGDLNPDNSDVDKLFIQLVQTYNQLFEENPIN*

ASGVDAKAILSARLSKSRRLENLIAQLPGEKKNGLFGNLIALSLGLTPNFKSNFDLAEDAKLQLSKDTYDD

*DLDNLLAQIGDQYADLFLAAKNLSDAILLSDILRVNTEITKAPLSASMIKRYDEHHQDLTLLKALVRQQLP*

*EKYKEIFFDQSKNGYAGYIDGGASQEEFYKFIKPILEKMDGTEELLVKLNREDLLRKQRTFDNGSIPHQI*

*HLGELHAILRRQEDFYPFLKDNREKIEKILTFRIPYYVGPLARGNSRFAWMTRKSEETITPWNFEEVVDK*

*GASAQSFIERMTNFDKNLPNEKVLPKHSLLYEYFTVYNELTKVKYVTEGMRKPAFLSGEQKKAIVDLLFK*

*TNRKVTVKQLKEDYFKKIECFDSVEISGVEDRFNASLGTYHDLLKIIKDKDFLDNEENEDILEDIVLTLTL*

*FEDREMIEERLKTYAHLFDDKVMKQLKRRRYTGWGRLSRKLINGIRDKQSGKTILDFLKSDGFANRNFM*

*QLIHDDSLTFKEDIQKAQVSGQGDSLHEHIANLAGSPAIKKGILQTVKVVDELVKVMGRHKPENIVIEMA*

*RENQTTQKGQKNSRERMKRIEEGIKELGSQILKEHPVENTQLQNEKLYLYYLQNGRDMYVDQELDINRL*

*SDYDVDHIVPQSFLKDDSIDNKVLTRSDKNRGKSDNVPSEEVVKKMKNYWRQLLNAKLITQRKFDNLTK*

*AERGGLSELDKAGFIKRQLVETRQITKHVAQILDSRMNTKYDENDKLIREVKVITLKSKLVSDFRKDFQF*

*YKVREINNYHHAHDAYLNAVVGTALIKKYPKLESEFVYGDYKVYDVRKMIAKSEQEIGKATAKYFFYSNIM*

*NFFKTEITLANGEIRKRPLIETNGETGEIVWDKGRDFATVRKVLSMPQVNIVKKTEVQTGGFSKESIRPKR*

*NSDKLIARKKDWDPKKYGGFVSPTVAYSVLVVAKVEKGKSKKLKSVKELLGITIMERSSFEKNPIDFLEAK*

*GYKEVKKDLIIKLPKYSLFELENGRKRMLASARFLQKGNELALPSKYVNFLYLASHYEKLKGSPEDNEQK*

*QLFVEQHKHYLDEHEQISEFSKRVILADANLDKVLSAYNKHRDKPIREQAENIIHLFTLTNLGAPRAFKYF*

*DTTIDRKVYRSTKEVLDATLIHQSITGLYETRIDLSQLGGDS*GGSGGSGGSTNLSDIIEKETGKQLVIQES

ILMLPEEVEEVIGNKPESDILVHTAYDESTDENVMLLTSDAPEYKPWALVIQDSNGENKIKMLSGG

SGGSGGSTNLSDIIEKETGKQLVIQESILMLPEEVEEVIGNKPESDILVHTAYDESTDENVMLLTSDA

PEYKPWALVIQDSNGENKIKMLSGGSKRTADGSEFEPKKKRKV

-continued

BE4max-SaKKH (SEQ ID NO: 369)

MKRTADGSEFESPKKKRKVSSETGPVAVDPTLRRRIEPHEFEVFFDPRELRKETCLLYEINWGGRH
SIWRHTSQNTNKHVEVNFIEKFTTERYFCPNTRCSITWFLSWSPCGECSRAITEFLSRYPHVTLFIYI
ARLYHHADPRNRQGLRDLISSGVTIQIMTEQESGYCWRNFVNYSPSNEAHWPRYPHLWVRLYVLE
LYCIILGLPPCLNILRRKQPQLTFFTIALQSCHYQRLPPHILWATGLKSGGSSGGSSGSETPGTSESAT
PESSGGSSGGS*KRNYILGLAIGITSVGYGIIDYETRDVIDAGVRLFKEANVENNEGRRSKRGARRLKRRR
RHRIQRVKKLLFDYNLLTDHSELSGINPYEARVKGLSQKLSEEEFSAALLHLAKRRGVHNVNEVEEDTGN
ELSTKEQISRNSKALEEKYVAELQLERLKKDGEVRGSINRFKTSDYVKEAKQLLKVQKAYHQLDQSFIDTY
IDLLETRRTYYEGPGEGSPFGWKDIKEWYEMLMGHCTYFPEELRSVKYAYNADLYNALNDLNNLVITRD
ENEKLEYYEKFQIIENVFKQKKKPTLKQIAKEILVNEEDIKGYRVTSTGKPEFTNLKVYHDIKDITARKEII
ENAELLDQIAKILTIYQSSEDIQEELTNLNSELTQEEIEQISNLKGYTGTHNLSLKAINLILDELWHTNDNQI
AIFNRLKLVPKKVDLSQQKEIPTTLVDDFILSPVVKRSFIQSIKVINAIIKKYGLPNDIIIELAREKNSKDAQK
MINEMQKRNRQTNERIEEHRITGKENAKYLIEKIKLHDMQEGKCLYSLEAIPLEDLLNNPFNYEVDHIIP
RSVSFDNSFNNKVLVKQEENSKKGNRTPFQYLSSSDSKISYETFKKHILNLAKGKGRISKTKKEYLLEERDI
NRFSVQKDFINRNLVDTRYATRGLMNLLRSYFRVNNLDVKVKSINGGFTSFLRRKWKFKKERNKGYKHH
AEDALHANADFIFKEWKKLDKAKKVMENQMFEEKQAESMPEIETEQEYKEIFITPHQIKHIKDFKDYKY
SHRVDKKPNRKLINDTLYSTRKDDKGNTLIVNNLNGLYDKDNDKLKKLINKSPEKLLMYHHDPQTYQKL
KLIMEQYGDEKNPLYKYYEETGNYLTKYSKKDNGPVIKKIKYYGNKLNAHLDITDDYPNSRNKVVKLSLK
PYRFDVYLDNGVYKFVTVKNLDVIKKENYYEVNSKCYEEAKKLKKISNQAEFIASFYKNDLIKINGELYRVI
GVNNDLLNRIEVNMIDITYREYLENMNDKRPPHIIKTIASKTQSIKKYSTDILGNLYEVKSKKHPQIIKKGS
GGSGGSGGSTNLSDHEKETGKQLVIQESILMLPEEVEEVIGNKPESDILVHTAYDESTDENVMLLTSDAP
EYKPWALVIQDSNGENKIKMLSGGSGGSGGSTNLSDHEKETGKQLVIQESILMLPEEVEEVIGNKPESDI
LVHTAYDESTDENVMLLTSDAPEYKPWALVIQDSNGENKIKMLSGGSKRTADGSEFEPKKKRKV*

BE4max-NRRH (SEQ ID NO: 370)

MKRTADGSEFESPKKKRKVSSETGPVAVDPTLRRRIEPHEFEVFFDPRELRKETCLLYEINWGGRH
SIWRHTSQNTNKHVEVNFIEKFTTERYFCPNTRCSITWFLSWSPCGECSRAITEFLSRYPHVTLFIYI
ARLYHHADPRNRQGLRDLISSGVTIQIMTEQESGYCWRNFVNYSPSNEAHWPRYPHLWVRLYVLE
LYCIILGLPPCLNILRRKQPQLTFFTIALQSCHYQRLPPHILWATGLKSGGSSGGSSGSETPGTSESAT
PESSGGSSGGS*DKKYSIGLTIGTNSVGWAVITDEYKVPSKKFKVLGNTDRHSIKKNLIGALLFDSGETAEA
TRLKRTARRRYTRRKNRICYLQEIFSNEMAKVDDSFFHRLEESFLVEEDKKHERHPIFGNIVDEVAYHEK
YPTIYHLRKKLVDSTDKADLRLIYLALAHMIKFRGHFLIEGDLNPDNSDVDKLFIQLVQTYNQLFEENPIN
ASGVDAKAILSARLSKSRRLENLIAQLPGEKKNGLFGNLIALSLGLTPNFKSNFDLAEDAKLQLSKDTYDD
DLDNLLAQIGDQYADLFLAAKNLSDAILLSDILRVNTEITKAPLSASMVKRYDEHHQDLTLLKALVRQQLP
EKYKEIFFDQSKNGYAGYIDGGASQEEFYKFIKPILEKMDGTEELLVKLNREDLISKQRTFDNGIIPHQI
HLGELHAILRRQGDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEENEDILEDIVLTLTL
FEDREMIEERLKTYAHLFDDKVMKQLKRLRYTGWGRLSRKLINGIRDKQSGKTILDFLKSDGFANRNFM
QLIHDDSLTFKEDIQKAQVSGQGDSLHEHIANLAGSPAIKKGILQTVKVVDELVKVMGGHKPENIVIEMA
RENQTTQKGQKNSRERMKRIEEGIKELGSQILKEHPVENTQLQNEKLYLYYLQNGRDMYVDQELDINRL*

-continued

*SDYDVDHIVPQSFLKDDSIDNKVLTRSDKNRGKSDNVPSEEVVKKMKNYWRQLLNAKLITQRKFDNLTK*

*AERGGLSELDKAGFIKRQLVETRQITKHVAQILDSRMNTKYDENDKLIREVKVITLKSKLVSDFRKDFQF*

*YKVREINNYHHAHDAYLNAVVGTALIKKYPKLESEFVYGDYKVYDVRKMIAKSEQEIGKATAKYFFYSNIM*

*NFFKTEITLANGEIRKRPLIETNGETGEIVWDKGRDFATVRKVLSMPQVNIVKKTEVQTGGFSKESILPKG*

*NSDKLIARKKDWDPKKYGGFNSPTAAYSVLVVAKVEKGKSKKLKSVKELLGITIMERSSFEKNPIGFLEA*

*KGYKEVKKDLIIKLPKYSLFELENGRKRMLASAGVLHKGNELALPSKYVNFLYLASHYEKLKGSPEDNEQ*

*KQLFVEQHKHYLDEHEQISEFSKRVILADANLDKVLSAYNKHRDKPIREQAENIIHLFTLTNLGVPAAFKY*

*FDTTIDKKRYTSTKEVLDATLIHQSITGLYETRIDLSQLGGDS*GGSGGSGGSTNLSDITEKETGKQLVIQE

SILMLPEEVEEVIGNKPESDILVHTAYDESTDENVMLLTSDAPEYKPWALVIQDSNGENKIKMLSG

GSGGSGGSTNLSDIIEKETGKQLVIQESILMLPEEVEEVIGNKPESDILVHTAYDESTDENVMLLTSD

APEYKPWALVIQDSNGENKIKMLSGGSKRTADGSEFEPKKKRKV

BE4max-VQR (SEQ ID NO: 371)

MKRTADGSEFESPKKKRKVSSETGPVAVDPTLRRRIEPHEFEVFFDPRELRKETCLLYEI

NWGGRHSIWRHTSQNTNKHVEVNFIEKFTTERYFCPNTRCSITWFLSWSPCGECSRA

ITEFLSRYPHVTLFIYIARLYHHADPRNRQGLRDLISSGVTIQIMTEQESGYCWRNFVN

YSPSNEAHWPRYPHLWVRLYVLELYCIILGLPPCLNILRRKQPQLTFFTIALQSCHYQ

RLPPHILWATGLKSGGSSGGSSGSETPGTSESATPESSGGSSGGS*DKKYSIGLAIGTNSVGWA*

*VITDEYKVPSKKFKVLGNTDRHSIKKNLIGALLFDSGETAEATRLKRTARRRYTRRKNRICYLQEI*

*FSNEMAKVDDSFFHRLEESFLVEEDKKHERHPIFGNIVDEVAYHEKYPTIYHLRKKLVDSTDKA*

*DLRLIYLALAHMIKFRGHFLIEGDLNPDNSDVDKLFIQLVQTYNQLFEENPINASGVDAKAILSA*

*RLSKSRRLENLIAQLPGEKKNGLFGNLIALSLGLTPNFKSNFDLAEDAKLQLSKDTYDDDLDNL*

*LAQIGDQYADLFLAAKNLSDAILLSDILRVNTEITKAPLSASMIKRYDEHHQDLTLLKALVRQQLP*

*EKYKEIFFDQSKNGYAGYIDGGASQEEFYKFIKPILEKMDGTEELLVKLNREDLLRKQRTFDNG*

*SIPHQIHLGELHAILRRQEDFYPFLKDNREKIEKILTFRIPYYVGPLARGNSRFAWMTRKSEETIT*

*PWNFEEVVDKGASAQSFIERMTNFDKNLPNEKVLPKHSLLYEYFTVYNELTKVKYVTEGMRKPA*

*FLSGEQKKAIVDLLFKTNRKVTVKQLKEDYFKKIECFDSVEISGVEDRFNASLGTYHDLLKIIKD*

*KDFLDNEENEDILEDIVLTLTLFEDREMIEERLKTYAHLFDDKVMKQLKRRRYTGWGRLSRKLI*

*NGIRDKQSGKTILDFLKSDGFANRNFMQLIHDDSLTFKEDIQKAQVSGQGDSLHEHIANLAGSP*

*AIKKGILQTVKVVDELVKVMGRHKPENIVIEMARENQTTQKGQKNSRERMKRIEEGIKELGSQI*

*LKEHPVENTQLQNEKLYLYYLQNGRDMYVDQELDINRLSDYDVDHIVPQSFLKDDSIDNKVLT*

*RSDKNRGKSDNVPSEEVVKKMKNYWRQLLNAKLITQRKFDNLTKAERGGLSELDKAGFIKRQL*

*VETRQITKHVAQILDSRMNTKYDENDKLIREVKVITLKSKLVSDFRKDFQFYKVREINNYHHAH*

*DAYLNAVVGTALIKKYPKLESEFVYGDYKVYDVRKMIAKSEQEIGKATAKYFFYSNIMNFFKTEIT*

*LANGEIRKRPLIETNGETGEIVWDKGRDFATVRKVLSMPQVNIVKKTEVQTGGFSKESILPKRNS*

*DKLIARKKDWDPKKYGGFVSPTVAYSVLVVAKVEKGKSKKLKSVKELLGITIMERSSFEKNPIDF*

LEAKGYKEVKKDLIIKLPKYSLFELENGRKRMLASAGELQKGNELALPSKYVNFLYLASHYEKLK

*GSPEDNEQKQLFVEQHKHYLDEIIEQISEFSKRVILADANLDKVLSAYNKHRDKPIREQAENIIH*

*LFTLTNLGAPAAFKYFDTTIDRIWYRSTKEVLDATLIHQSITGLYETRIDLSQLGGD*SGGSGGSG

GSTNLSDIIEKETGKQLVIQESILMLPEEVEEVIGNKPESDILVHTAYDESTDENVMLLTSDA

PEYKPWALVIQDSNGENKIKMLSGGSGGSGGSTNLSDIIEKETGKQLVIQESILMLPEEVEE

-continued

VIGNKPESDILVHTAYDESTDENVMLLTSDAPEYKPWALVIQDSNGENKIKMLSGGSKRTA

DGSEFEPKKKRKV

BE4max-VRQR (SEQ ID NO: 372)

MKRTADGSEFESPKKKRKVSSETGPVAVDPTLRRRIEPHEFEVFFDPRELRKETCLLYEI

NWGGRHSIWRHTSQNTNKHVEVNFIEKFTTERYFCPNTRCSITWFLSWSPCGECSRA

ITEFLSRYPHVTLFIYIARLYHHADPRNRQGLRDLISSGVTIQIMTEQESGYCWRNFVN

YSPSNEAHWPRYPHLWVRLYVLELYCIILGLPPCLNILRRKQPQLTFFTIALQSCHYQ

RLPPHILWATGLKSGGSSGGSSGSETPGTSESATPESSGGSSGGS*DKKYSIGLAIGTNSVGWA*

*VITDEYKVPSKKFKVLGNTDRHSIKKNLIGALLFDSGETAEATRLKRTARRRYTRRKNRICYLQEI*

*FSNEMAKVDDSFFHRLEESFLVEEDKKHERHPIFGNIVDEVAYHEKYPTIYHLRKKLVDSTDKA*

*DLRLIYLALAHMIKFRGHFLIEGDLNPDNSDVDKLFIQLVQTYNQLFEENPINASGVDAKAILSA*

*RLSKSRRLENLIAQLPGEKKNGLFGNLIALSLGLTPNFKSNFDLAEDAKLQLSKDTYDDDLDNL*

*LAQIGDQYADLFLAAKNLSDAILLSDILRVNTEITKAPLSASMIKRYDEHHQDLTLLKALVRQQLP*

*EKYKEIFFDQSKNGYAGYIDGGASQEEFYKFIKPILEKMDGTEELLVKLNREDLLRKQRTFDNG*

*SIPHQIHLGELHAILRRQEDFYPFLKDNREKIEKILTFRIPYYVGPLARGNSRFAWMTRKSEETIT*

*PWNFEEVVDKGASAQSFIERMTNFDKNLPNEKVLPKHSLLYEYFTVYNELTKVKYVTEGMRKPA*

*FLSGEQKKAIVDLLFKTNRKVTVKQLKEDYFKKIECFDSVEISGVEDRFNASLGTYHDLLKIIKD*

*KDFLDNEENEDILEDIVLTLTLFEDREMIEERLKTYAHLFDDKVMKQLKRRRYTGWGRLSRKLI*

*NGIRDKQSGKTILDFLKSDGFANRNFMQLIHDDSLTFKEDIQKAQVSGQGDSLHEHIANLAGSP*

*AIKKGILQTVKVVDELVKVMGRHKPENIVIEMARENQTTQKGQKNSRERMKRIEEGIKELGSQI*

*LKEHPVENTQLQNEKLYLYYLQNGRDMYVDQELDINRLSDYDVDHIVPQSFLKDDSIDNKVLT*

*RSDKNRGKSDNVPSEEVVKKMKNYWRQLLNAKLITQRKFDNLTKAERGGLSELDKAGFIKRQL*

*VETRQITKHVAQILDSRMNTKYDENDKLIREVKVITLKSKLVSDFRKDFQFYKVREINNYHHAH*

*DAYLNAVVGTALIKKYPKLESEFVYGDYKVYDVRKMIAKSEQEIGKATAKYFFYSNIMNFFKTEIT*

*LANGEIRKRPLIETNGETGEIVWDKGRDFATVRKVLSMPQVNIVKKTEVQTGGFSKESILPKRNS*

*DKLIARKKDWDPKKYGGFVSPTVAYSVLVVAKVEKGKSKKLKSVKELLGITIMERSSFEKNPIDF*

*LEAKGYKEVKKDLIIKLPKYSLFELENGRKRMLASARELQKGNELALPSKYVNFLYLASHYEKLK*

*GSPEDNEQKQLFVEQHKHYLDEIIEQISEFSKRVILADANLDKVLSAYNKHRDKPIREQAENIIH*

*LFTLTNLGAPAAFKYFDTTIDRIWYRSTKEVLDATLIHQSITGLYETRIDLSQLGGD*SGGSGGSG

GSTNLSDIIEKETGKQLVIQESILMLPEEVEEVIGNKPESDILVHTAYDESTDENVMLLTSDA

PEYKPWALVIQDSNGENKIKMLSGGSGGSGGSTNLSDIIEKETGKQLVIQESILMLPEEVEE

VIGNKPESDILVHTAYDESTDENVMLLTSDAPEYKPWALVIQDSNGENKIKMLSGGSKRTA

DGSEFEPKKKRKV

Adenine Nucleobase Editors

In some aspects, the base editing methods of the disclosure comprise the use of an adenine nucleobase editor. Exemplary adenine nucleobase editors include, but are not limited to, ABE7.10 (or ABEmax), ABE8e, ABE8e-SaKKH, ABE8e-NG, ABE-xCas9, ABE7.10-SaKKH, ABE7.10-NG, ABE7.10-VRQR, ABE7.10-VQR, ABE8e-NRTH, ABE8e-NRRH, ABE8e-VQR, or ABE8e-VRQR. In certain embodiments, the adenine nucleobase editor used in the disclosed methods is an ABE8e or an ABE7.10. ABE8e is sometimes referred to herein as "ABE8" or "ABE8.0". The ABE8e nucleobase editor and variants thereof may comprise an adenosine deaminase domain containing a TadA-8e adenosine deaminase monomer (monomer form) or a TadA-8e adenosine deaminase homodimer or heterodimer (dimer form). Other ABEs may be used to deaminate an A nucleobase in accordance with the disclosed methods.

In some aspects, the disclosure provides complexes of adenine nucleobase editors and guide RNAs. Exemplary adenine nucleobase editors of the disclosed complexes include, but are not limited to, ABE7.10 (or ABEmax), ABE8e, ABE8e-SaKKH, ABE8e-NG, ABE-xCas9, ABE7.10-SaKKH, ABE7.10-NG, ABE7.10-VRQR, ABE7.10-VQR, ABE8e-NRTH, ABE8e-NRRH, ABE8e-

VQR, or ABE8e-VRQR. In certain embodiments, the adenine nucleobase editor of any of the disclosed complexes is a ABE8e or an ABE7.10. Other ABEs may be used to deaminate a A nucleobase in accordance with the disclosed complexes.

The disclosed complexes of ABEs may possess an on-target editing efficiency of more than 50% after being contacted with a nucleic acid molecule comprising a target sequence. Further exemplary ABE complexes possess an on-target editing efficiency of more than 60% after being contacted with a nucleic acid molecule comprising a target sequence. Further exemplary ABEs possess an on-target editing efficiency of more than 65%, more than 70%, more than 75%, more than 80%, more than 82.5%, or more than 85% after being contacted with a nucleic acid molecule comprising a target sequence. The disclosed ABE complexes may exhibit indel frequencies of less than 0.75%, less than 0.6%, less than 0.5%, less than 0.4%, less than 0.3%, or less than 0.2% after being contacted with a nucleic acid molecule containing a target sequence.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprises two adenosine deaminases. In some embodiments, any of the fusion proteins provided herein contains only two adenosine deaminases. In some embodiments, the adenosine deaminases are the same. In some embodiments, the adenosine deaminases are any of the adenosine deaminases provided herein. In some embodiments, the adenosine deaminases are different.

In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 10, which contains a W23R; H36L; P48A; R51L; L84F; A106V; D108N; H123Y; S146C; D147Y; R152P; E155V; I156F; and K157N mutation from ecTadA (SEQ ID NO: 1). In some embodiments, the fusion protein may comprise a first adenosine deaminase that comprises the amino acid sequence of SEQ ID NO: 1, and a second adenosine deaminase domain that comprises the amino acid sequence of TadA7.10 of SEQ ID NO: 10. In certain embodiments, the first and/or second deaminase is a TadA-8e deaminase. Additional fusion protein constructs comprising two adenosine deaminase domains are illustrated herein and are provided in the art.

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the linker comprises the amino acid sequence of any one of SEQ ID NOs: 135-152. In some embodiments, the linker is 32 amino acids in length. In some embodiments, the linker comprises the amino acid sequence $(SGGS)_2$-SGSETPGTSESATPES-$(SGGS)_2$ (SEQ ID NO: 136), which may also be referred to as $(SGGS)_2$-XTEN-$(SGGS)_2$ (SEQ ID NO: 136). In some embodiments, the linker comprises the amino acid sequence $(SGGS)_n$-SG-SETPGTSESATPES-$(SGGS)_n$ (SEQ ID NO: 142), wherein n is 0, 1, 2, 3, 4, 5, 6, 7, 8, 9, or 10. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1-10, or to any of the adenosine deaminases provided herein. In some embodiments, the first adenosine deaminase comprises the amino acid sequence of SEQ ID NO: 1. In some embodiments, the second adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1-10, or to any of the adenosine deaminases provided herein. In some embodiments, the second adenosine deaminase comprises the amino acid sequence of SEQ ID NO: 10.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), $NH_2$ is the N-terminus of the fusion protein, and COOH is the C-terminus of the fusion protein.

Fusion proteins comprising a first adenosine deaminase, a second adenosine deaminase, and a napDNAbp.

$NH_2$-[first adenosine deaminase]-[second adenosine deaminase]-[napDNAbp]-COOH;

$NH_2$-[first adenosine deaminase]-[napDNAbp]-[second adenosine deaminase]-COOH;

$NH_2$-[napDNAbp]-[first adenosine deaminase]-[second adenosine deaminase]-COOH;

$NH_2$-[second adenosine deaminase]-[first adenosine deaminase]-[napDNAbp]-COOH;

$NH_2$-[second adenosine deaminase]-[napDNAbp]-[first adenosine deaminase]-COOH;

$NH_2$-[napDNAbp]-[second adenosine deaminase]-[first adenosine deaminase]-COOH.

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "]-[" used in the general architecture above indicates the presence of an optional linker.

Fusion proteins comprising a first adenosine deaminase, a second adenosine deaminase, a napDNAbp, and an NLS.

$NH_2$-[NLS]-[first adenosine deaminase]-[second adenosine deaminase]-[napDNAbp]-COOH;

$NH_2$-[first adenosine deaminase]-[NLS]-[second adenosine deaminase]-[napDNAbp]-COOH;

$NH_2$-[first adenosine deaminase]-[second adenosine deaminase]-[NLS]-[napDNAbp]-COOH;

$NH_2$-[first adenosine deaminase]-[second adenosine deaminase]-[napDNAbp]-[NLS]-COOH;

$NH_2$-[NLS]-[first adenosine deaminase]-[napDNAbp]-[second adenosine deaminase]-COOH;

$NH_2$-[first adenosine deaminase]-[NLS]-[napDNAbp]-[second adenosine deaminase]-COOH;

$NH_2$-[first adenosine deaminase]-[napDNAbp]-[NLS]-[second adenosine deaminase]-COOH;

$NH_2$-[first adenosine deaminase]-[napDNAbp]-[second adenosine deaminase]-[NLS]-COOH;

$NH_2$-[NLS]-[napDNAbp]-[first adenosine deaminase]-[second adenosine deaminase]-COOH;

$NH_2$-[napDNAbp]-[NLS]-[first adenosine deaminase]-[second adenosine deaminase]-COOH;

$NH_2$-[napDNAbp]-[first adenosine deaminase]-[NLS]-[second adenosine deaminase]-COOH;

$NH_2$-[napDNAbp]-[first adenosine deaminase]-[second adenosine deaminase]-[NLS]-COOH;

$NH_2$-[NLS]-[second adenosine deaminase]-[first adenosine deaminase]-[napDNAbp]-COOH;

$NH_2$-[second adenosine deaminase]-[NLS]-[first adenosine deaminase]-[napDNAbp]-COOH;

$NH_2$-[second adenosine deaminase]-[first adenosine deaminase]-[NLS]-[napDNAbp]-COOH;

$NH_2$-[second adenosine deaminase]-[first adenosine deaminase]-[napDNAbp]-[NLS]-COOH;

$NH_2$-[NLS]-[second adenosine deaminase]-[napDNAbp]-[first adenosine deaminase]-COOH;

$NH_2$-[second adenosine deaminase]-[NLS]-[napDNAbp]-[first adenosine deaminase]-COOH;

$NH_2$-[second adenosine deaminase]-[napDNAbp]-[NLS]-[first adenosine deaminase]-COOH;

$NH_2$-[second adenosine deaminase]-[napDNAbp]-[first adenosine deaminase]-[NLS]-COOH;

$NH_2$-[NLS]-[napDNAbp]-[second adenosine deaminase]-[first adenosine deaminase]-COOH;

$NH_2$-[napDNAbp]-[NLS]-[second adenosine deaminase]-[first adenosine deaminase]-COOH;

$NH_2$-[napDNAbp]-[second adenosine deaminase]-[NLS]-[first adenosine deaminase]-COOH;

$NH_2$-[napDNAbp]-[second adenosine deaminase]-[first adenosine deaminase]-[NLS]-COOH.

Exemplary ABEs include, without limitation, the following fusion proteins. For the purposes of clarity, the adenosine deaminase domain may be shown in Bold; mutations of the ecTadA deaminase domain are shown in Bold underlining; the XTEN linker is shown in italics; the UGI/AAG/EndoV domains are shown in Bold italics; and NLS is shown in underlined italics:

In some embodiments, an A to G nucleobase editor comprises the structure of NH2-[second adenosine deaminase]-[first adenosine deaminase]-[dCas9]-COOH. In some embodiments, the second adenosine deaminase is a wile-type ecTadA (SEQ ID NO: 314). In some embodiments, the a linker is used between each domain. In some embodiments, the linker is 32 amino acids long and comprises the amino acid sequence of SGGSSGGSSGSETPGTSESATPESSGGSSGGS (SEQ ID NO: 384).

Exemplary adenine nucleobase editors comprise amino acid sequences that are at least least 85%, at least 90%, at least 95%, at least 98%, at least 99%, or at least 99.5% identical to any one of the amino acid sequences SEQ ID NOs: 379, 380, 382, 383, 386, and 388, 478 and 483. In particular embodiments, the disclosed adenine nucleobase editors comprise an amino acid sequence that is at least 90% identical to any of SEQ ID NOs: 388, 478, and 483. In particular embodiments, the disclosed adenine nucleobase editors comprise an amino acid sequence of any of SEQ ID NOs: 388, 478 and 483.

Non-limiting examples of A to G nucleobase editors are provided below, as SEQ ID NOs: 323-342, 379-383, 385-388, 458-478, 480, 483, and 553, provided below.

ecTadA(wt)-XTEN-nCas9-NLS (SEQ ID NO: 323)

```
MSEVEFSHEYWMRHALTLAKRAWDEREVPVGAVLVHNNRVIGEGWNRPIGRHDPTAHAEIMALRQGGLV
MQNYRLIDATLYVTLEPCVMCAGAMIHSRIGRVVFGARDAKTGAAGSLMDVLHHPGMNHRVEITEGILADE
CAALLSDFFRMRRQEIKAQKKAQSSTDSGSETPGTSESATPESDKKYSIGLAIGTNSVGWAVITDEYKVPSKK
FKVLGNTDRHSIKKNLIGALLFDSGETALATRLKRTARRRYTRRKNRICYLQEIFSNEMAKVDDSFFHRLEES
FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
```

-continued

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV ecTadA(D108N)-XTEN-nCas9-NLS: (mammalian construct, active on DNA)

(SEQ ID NO: 324)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV ecTadA(D108G)-XTEN-nCas9-NLS: (mammalian construct, active on DNA, A to G editing (SEQ ID NO: 325)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARGAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

-continued

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV ecTadA(D108V)-XTEN-nCas9-NLS: (mammalian construct, active on DNA, A to G editing (SEQ ID NO: 326)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARVAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV ecTadA(D108N)-XTEN-nCas9-UGI-NLS (BE3 analog of A to G editor)

(SEQ ID NO: 327)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMNHRVEITEGILADE

-continued

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGSPKKKRKV ecTadA(D108G)-XTEN-nCas9-UGI-NLS (BE3 analog of A to G editor)

(SEQ ID NO: 328)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARGAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

-continued

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGSPKKKRKV ecTadA(D108V)-XTEN-nCas9-UGI-NLS (BE3 analog of A to G editor)
(SEQ ID NO: 329)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARVAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGSPKKKRKV ecTadA(D108N)-XTEN-dCas9-UGI-NLS (mammalian cells, BE2 analog of A to G editor)
(SEQ ID NO: 330)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

-continued

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGSPKKKRKV ecTadA(D108G)-XTEN-dCas9-UGI-NLS (mammalian cells, BE2 analog of A to G editor)
(SEQ ID NO: 331)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARGAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGSPKKKRKV ecTadA(D108V)-XTEN-dCas9-UGI-NLS (mammalian cells, BE2 analog of A to G editor)
(SEQ ID NO: 332)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARVAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDAIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY
LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSTNLSDIIEKETGKQLVIQESILMLPEEVEEVIGNKPESDILVH
TAYDESTDENVMLLTSDAPEYKPWALVIQDSNGENKIKMLSGGSPKKKRKV ecTadA(D108N)-XTEN-nCas9-AAG(E125Q)-NLS-cat. alkyladenosine glycosylase (SEQ ID NO: 333)

MSEVEFSHEYWMRHALTLAKRAWDEREVPVGAVLVHNNRVIGEGWNRPIGRHDPTAHAEIMALRQGGLV
MQNYRLIDATLYVTLEPCVMCAGAMIHSRIGRVVFGARNAKTGAAGSLMDVLHHPGMNHRVEITEGILADE
CAALLSDFFRMRRQEIKAQKKAQSSTDSGSETPGTSESATPESDKKYSIGLAIGTNSVGWAVITDEYKVPSKK
FKVLGNTDRHSIKKNLIGALLFDSGETALATRLKRTARRRYTRRKNRICYLQEIFSNEMAKVDDSFFHRLEES
FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY

-continued

LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSKGHLTRLGLEFFDQPAVPLARAFLGQVLVRRLPNGTELRGRI
VETQAYLGPEDEAAHSRGGRQTPRNRGMFMKPGTLYVYIIYGMYFCMNISSQGDGACVLLRALEPLEGLET
MRQLRSTLRKGTASRVLKDRELCSGPSKLCQALAINKSFDQRDLAQDEAVWLERGPLEPSEPAVVAAARVG
VGHAGEWARKPLRFYVRGSPWVSVVDRVAEQDTQASGGSPKKKRKV ecTadA(D108G)-XTEN-nCas9-AAG(E125Q)-NLS-cat. alkyladenosine glycosylase (SEQ ID NO: 334)

MSEVEFSHEYWMRHALTLAKRAWDEREVPVGAVLVHNNRVIGEGWNRPIGRHDPTAHAEIMALRQGGLV
MQNYRLIDATLYVTLEPCVMCAGAMIHSRIGRVVFGARGAKTGAAGSLMDVLHHPGMNHRVEITEGILADE
CAALLSDFFRMRRQEIKAQKKAQSSTDSGSETPGTSESATPESDKKYSIGLAIGTNSVGWAVITDEYKVPSKK
FKVLGNTDRHSIKKNLIGALLFDSGETALATRLKRTARRRYTRRKNRICYLQEIFSNEMAKVDDSFFHRLEES
FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY
LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSKGHLTRLGLEFFDQPAVPLARAFLGQVLVRRLPNGTELRGRI
VETQAYLGPEDEAAHSRGGRQTPRNRGMFMKPGTLYVYIIYGMYFCMNISSQGDGACVLLRALEPLEGLET
MRQLRSTLRKGTASRVLKDRELCSGPSKLCQALAINKSFDQRDLAQDEAVWLERGPLEPSEPAVVAAARVG
VGHAGEWARKPLRFYVRGSPWVSVVDRVAEQDTQASGGSPKKKRKV ecTadA(D108V)-XTEN-nCas9-AAG(E125Q)-NLS-cat. alkyladenosine glycosylase (SEQ ID NO: 335)

MSEVEFSHEYWMRHALTLAKRAWDEREVPVGAVLVHNNRVIGEGWNRPIGRHDPTAHAEIMALRQGGLV
MQNYRLIDATLYVTLEPCVMCAGAMIHSRIGRVVFGARVAKTGAAGSLMDVLHHPGMNHRVEITEGILADE
CAALLSDFFRMRRQEIKAQKKAQSSTDSGSETPGTSESATPESDKKYSIGLAIGTNSVGWAVITDEYKVPSKK
FKVLGNTDRHSIKKNLIGALLFDSGETALATRLKRTARRRYTRRKNRICYLQEIFSNEMAKVDDSFFHRLEES
FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE

-continued

ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY
LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSKGHLTRLGLEFFDQPAVPLARAFLGQVLVRRLPNGTELRGRI
VETQAYLGPEDEAAHSRGGRQTPRNRGMFMKPGTLYVYIIYGMYFCMNISSQGDGACVLLRALEPLEGLET
MRQLRSTLRKGTASRVLKDRELCSGPSKLCQALAINKSFDQRDLAQDEAVWLERGPLEPSEPAVVAAARVG
VGHAGEWARKPLRFYVRGSPWVSVVDRVAEQDTQASGGSPKKKRKV ecTadA(D108N)-XTEN-nCas9-EndoV(D35A)-NLS: contains cat. endonuclease V
(SEQ ID NO: 336)

MSEVEFSHEYWMRHALTLAKRAWDEREVPVGAVLVHNNRVIGEGWNRPIGRHDPTAHAEIMALRQGGLV
MQNYRLIDATLYVTLEPCVMCAGAMIHSRIGRVVFGARNAKTGAAGSLMDVLHHPGMNHRVEITEGILADE
CAALLSDFFRMRRQEIKAQKKAQSSTDSGSETPGTSESATPESDKKYSIGLAIGTNSVGWAVITDEYKVPSKK
FKVLGNTDRHSIKKNLIGALLFDSGETALATRLKRTARRRYTRRKNRICYLQEIFSNEMAKVDDSFFHRLEES
FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY
LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSDLASLRAQQIELASSVIREDRLDKDPPDLIAGAAVGFEQGGE
VTRAAMVLLKYPSLELVEYKVARIATTMPYIPGFLSFREYPALLAAWEMLSQKPDLVFVDGHGISHPRRLGV

-continued

ASHFGLLVDVPTIGVAKKRLCGKFEPLSSEPGALAPLMDKGEQLAWVWRSKARCNPLFIATGHRVSVDSAL

AWVQRCMKGYRLPEPTRWADAVASERPAFVRYTANQPSGGSPKKKRKV ecTadA(D108G)-XTEN-nCas9-EndoV(D35A)-NLS: contains cat. endonuclease V (SEQ ID NO: 337)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARGAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSDLASLRAQQIELASSVIREDRLDKDPPDLIAGAAVGFEQGGE

VTRAAMVLLKYPSLELVEYKVARIATTMPYIPGFLSFREYPALLAAWEMLSQKPDLVFVDGHGISHPRRLGV

ASHFGLLVDVPTIGVAKKRLCGKFEPLSSEPGALAPLMDKGEQLAWVWRSKARCNPLFIATGHRVSVDSAL

AWVQRCMKGYRLPEPTRWADAVASERPAFVRYTANQPSGGSPKKKRKV ecTadA(D108V)-XTEN-nCas9-EndoV(D35A)-NLS: contains cat. endonuclease V (SEQ ID NO: 338)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARVAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

-continued

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSDLASLRAQQIELASSVIREDRLDKDPPDLIAGAAVGFEQGGE

VTRAAMVLLKYPSLELVEYKVARIATTMPYIPGFLSFREYPALLAAWEMLSQKPDLVFVDGHGISHPRRLGV

ASHFGLLVDVPTIGVAKKRLCGKFEPLSSEPGALAPLMDKGEQLAWVWRSKARCNPLFIATGHRVSVDSAL

AWVQRCMKGYRLPEPTRWADAVASERPAFVRYTANQPSGGSPKKKRKV

Variant resulting from first round of evolution (in bacteria) ecTadA(H8Y_D108N_N127S)-XTEN-dCas9

(SEQ ID NO: 339)

MSEVEFSYEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMSHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGD

Enriched variants from second round of evolution (in bacteria) ecTadA (H8Y_D108N_N127S_E155X)-XTEN-dCas9; X = D, G or V (SEQ ID NO: 340)

MSEVEFSYEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMSHRVEITEGILADE

-continued

CAALLSDFFRMRRQXIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGD pNMG-160: ecTadA(D108N)-XTEN-nCas9-GGS-AAG*(E125Q)-GGS-NLS (SEQ ID NO: 341)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

-continued

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDGGSKGHLTRLGLEFFDQPAVPLARAFLGQVLVRRLPNGTELRGRI

VETQAYLGPEDEAAHSRGGRQTPRNRGMFMKPGTLYVYIIYGMYFCMNISSQGDGACVLLRALEPLEGLET

MRQLRSTLRKGTASRVLKDRELCSGPSKLCQALAINKSFDQRDLAQDEAVWLERGPLEPSEPAVVAAARVG

VGHAGEWARKPLRFYVRGSPWVSVVDRVAEQDTQAGGSPKKKRKV pNMG-161: ecTadA(D108N)-XTEN-nCas9-GGS-EndoV*(D35A)-GGS-NLS (SEQ ID NO: 342)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARNAKTGAAGSLMDVLHHPGMNHRVEITEGILADE

CAALLSDFFRMRRQEIKAQKKAQSSTDSGSETPGTSESATPESDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDGGSDLASLRAQQIELASSVIREDRLDKDPPDLIAGAAVGFEQGGEV

TRAAMVLLKYPSLELVEYKVARIATTMPYIPGFLSFREYPALLAAWEMLSQKPDLVFVDGHGISHPRRLGVA

SHFGLLVDVPTIGVAKKRLCGKFEPLSSEPGALAPLMDKGEQLAWVWRSKARCNPLFIATGHRVSVDSALA

WVQRCMKGYRLPEPTRWADAVASERPAFVRYTANQPGGSPKKKRKV pNMG-371: ecTadA(L84F_A106V_D108N_H123Y_D147Y_E155V_I156F)-SGGS-SGGS-XTEN-SGGS-SGGS-ecTadA(L84F_A106V_D108N_H123Y_D147Y_E155V_I156F)-SGGS-SGGS-XTEN-SGGS-SGGS-nCas9-SGGS-NLS (SEQ ID NO: 458)

SEVEFSHEYWMRHALTLAKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHYPGMNHRVEITEGILADEC

AALLSYFFRMRRQVFKAQKKAQSSTDSGGSSGGSSGSETPGTSESATPESSGGSSGGSSEVEFSHEYWMRHA

LTLAKRAWDEREVPVGAVLVHNNRVIGEGWNRPIGRHDPTAHAEIMALRQGGLVMQNYRLIDATLYVTFEP

CVMCAGAMIHSRIGRVVFGVRNAKTGAAGSLMDVLHYPGMNHRVEITEGILADECAALLSYFFRMRRQVF

KAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETALATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-616 amino acid sequence: ecTadA(wild type)-(SGGS)2-XTEN-(SGGS)2-
ecTadA(W23L_H36L_P48A_R51L_L84F_A106V_D108N_H123Y_S146C_D147Y_R152P_E155V_
I156F_K157N)-(SGGS)2-XTEN-(SGGS)2_nCas9_SGGS_NLS (SEQ ID NO: 459)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

-continued

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-624 amino acid sequence: ecTadA(wild type)-32 a.a. linker-ecTadA(W23R_H36L_P48A_R51L_L84F_A106V_D108N_123Y_S146C_D147Y_R152P_E155V_I156F_K157N)-24 a.a. linker_nCas9_SGGS_NLS (SEQ ID NO: 460)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRLSDYDVDHI

VPQSFLKDDSIDNKVLTRSDKNRGKSDNVPSEEVVKKMKNYWRQLLNAKLITQRKFDNLTKAERGGLSELD

KAGFIKRQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV pNMG-476 amino acid sequence (evolution #3 hetero dimer, wt TadA + TadA evo #3 mutations): ecTadA(wild-type)-(SGGS)2-XTEN-(SGGS)2-ecTadA(L84F_A106V_D108N_H123Y_D147Y_E155V_I156F)-(SGGS)2-XTEN-(SGGS)2_nCas9_SGGS_NLS (SEQ ID NO: 461)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVHNNRVIGEGWNRPIGRHDPTAHAEIMALRQGGLVMQNYRLIDATLYVTFEP

CVMCAGAMIHSRIGRVVFGVRNAKTGAAGSLMDVLHYPGMNHRVEITEGILADECAALLSYFFRMRRQVF

KAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-477 amino acid sequence: ecTadA(wild-type)-(SGGS)2-XTEN-(SGGS)2-ecTadA(H36L_R51L_L84F_A106V_D108N_H123Y_S146C_D147Y_E155V_I156F_K157N)-(SGGS)2-XTEN-(SGGS)2_nCas9_SGGS_NLS (SEQ ID NO: 462)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRPIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

-continued

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-558 amino acid sequence: ecTadA(wild-type)-32 a.a. linker-ecTadA(H36L_R51L_L84F_A106V_D108N_H123Y_S146C_D147Y_E155V_I156F_K157N)-24 a.a. linker_nCas9_SGGS_NLS (SEQ ID NO: 463)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRPIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMRRQVF

NAQKKAQSSTDSGGSSGGSSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRLSDYDVDHI

VPQSFLKDDSIDNKVLTRSDKNRGKSDNVPSEEVVKKMKNYWRQLLNAKLITQRKFDNLTKAERGGLSELD

KAGFIKRQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV pNMG-576 amino acid sequence: ecTadA(wild-type)-(SGGS)2-XTEN-(SGGS)2-ecTadA(H36L_P48S_R51L_L84F_A106V_D108N_H123Y_S146C_D147Y_E155V_I156F K157N)-(SGGS)2-XTEN-(SGGS)2_nCas9_GGS_NLS (SEQ ID NO: 464)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRSIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-577 amino acid sequence: ecTadA(wild-type)-(SGGS)2-XTEN-(SGGS)2-ecTadA(H36L_P48S_R51L_L84F_A106V_D108N_H123Y_S146C_A142N_D147Y_E155V_I156F_K157N)-(SGGS)2-XTEN-(SGGS)2_nCas9_GGS_NLS (SEQ ID NO: 465)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRSIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

-continued

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-586 amino acid sequence: ecTadA(wild-type)-(SGGS)2-XTEN-(SGGS)2-ecTadA(H36L_P48A_R51L_L84F_A106V_D108N_H123Y_S146C_D147Y_E155V_I156F_K157N)-(SGGS)2-XTEN-(SGGS)2_nCas9_GGS_NLS (SEQ ID NO: 466)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-588 amino acid sequence: ecTadA(wild-type)-(SGGS)2-XTEN-(SGGS)2-ecTadA(H36L_P48A_R51L_L84F_A106V_D108N_H123Y_S146C_A142N_D147Y_E155V_I156F_K157N)-(SGGS)2-XTEN-(SGGS)2_nCas9_GGS_NLS (SEQ ID NO: 467)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-620 amino acid sequence: ecTadA(wild-type)-(SGGS)2-XTEN-(SGGS)2-
ecTadA(W23R_H36L_P48A_R51L_L84F_A106V_D108N_H123Y_S146C_D147Y_R152P_E155V_
I156F_K157N)-(SGGS)2-XTEN-(SGGS)2_nCas9_GGS_NLS (SEQ ID NO: 468)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

-continued

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-617 amino acid sequence: ecTadA(wild-type)-(SGGS)2-XTEN-(SGGS)2-ecTadA(W23L_H36L_P48A_R51L_L84F_A106V_D108N_H123Y_A142A_S146C_D147Y_E155V_I156F_K157N)-(SGGS)2-XTEN-(SGGS)2_nCas9_GGS_NLS (SEQ ID NO: 469)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-618 amino acid sequence: ecTadA(wild-type)-(SGGS)2-XTEN-(SGGS)2-ecTadA(W23L_H36L_P48A_R51L_L84F_A106V_D108N_H123Y_A142A_S146C_D147Y_R152P_E155V_I156F_K157N)-(SGGS)2-XTEN-(SGGS)2_nCas9_GGS_NLS (SEQ ID NO: 470)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMAPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-620 amino acid sequence: ecTadA(wild-type)-(SGGS)2-XTEN-(SGGS)2-ecTadA(W23R_H36L_P48A_R51L_L84F_A106V_D108N_H123Y_S146C_D147Y_R152P_E155V_I156F_K157N)-(SGGS)2-XTEN-(SGGS)2_nCas9_GGS_NLS (SEQ ID NO: 471)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

-continued

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV pNMG-621 amino acid sequence: ecTadA(wild-type)-32 a.a. linker-ecTadA(H36L_P48A_R51L_L84F_A106V_D108N_H123Y_S146C_D147Y_R152P_E155V_I156F_K157N)-24 a.a. linker nCas9_GGS_NLS (SEQ ID NO: 472)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRLSDYDVDHI

VPQSFLKDDSIDNKVLTRSDKNRGKSDNVPSEEVVKKMKNYWRQLLNAKLITQRKFDNLTKAERGGLSELD

KAGFIKRQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV pNMG-622 amino acid sequence: ecTadA(wild-type)-32 a.a. linker-ecTadA(H36L_P48A_R51L_L84F_A106V_D108N_H123Y_A142N_S146C_D147Y_R152P_E155V_I156F_K157N)-24 a.a. linker_nCas9_GGS_NLS (SEQ ID NO: 473)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMPRQVF

NAQKKAQSSTDSGGSSGGSSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFLVEEDKK

-continued

HERHPIFGNIVDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRLSDYDVDHI

VPQSFLKDDSIDNKVLTRSDKNRGKSDNVPSEEVVKKMKNYWRQLLNAKLITQRKFDNLTKAERGGLSELD

KAGFIKRQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV pNMG-623 amino acid sequence: ecTadA(wild-type)-32 a.a. linker-ecTadA(W23L_H36L_P48A_R51L_L84F_A106V_D108N_H123Y_S146C_D147Y_R152P_E155V_I156F_K157N)-24 a.a. linker_nCas9_GGS_NLS (SEQ ID NO: 474)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGLTPNFKSNFDLAE

DAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDFLKSDGFANRNFMQLI

HDDSLTFKEDIQKAQVSGQGDSLHEHIANLAGSPAIKKGILQTVKVVDELVKVMGRHKPENIVIEMARENQT

TQKGQKNSRERMKRIEEGIKELGSQILKEHPVENTQLQNEKLYLYYLQNGRDMYVDQELDINRLSDYDVDHI

VPQSFLKDDSIDNKVLTRSDKNRGKSDNVPSEEVVKKMKNYWRQLLNAKLITQRKFDNLTKAERGGLSELD

KAGFIKRQLVETRQITKHVAQILDSRMNTKYDENDKLIREVKVITLKSKLVSDFRKDFQFYKVREINNYHHA

HDAYLNAVVGTALIKKYPKLESEFVYGDYKVYDVRKMIAKSEQEIGKATAKYFFYSNIMNFFKTEITLANGE

-continued

IRKRPLIETNGETGEIVWDKGRDFATVRKVLSMPQVNIVKKTEVQTGGFSKESILPKRNSDKLIARKKDWDPK

KYGGFDSPTVAYSVLVVAKVEKGKSKKLKSVKELLGITIMERSSFEKNPIDFLEAKGYKEVKKDLIIKLPKYS

LFELENGRKRMLASAGELQKGNELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKYFDTTIDRKRYTSTKEVLDATLIH

QSITGLYETRIDLSQLGGDSGGSPKKKRKV

ABE6.3 ecTadA(wild-type)-(SGGS)2-XTEN-(SGGS)2-
ecTadA(H36L_P48S_R51L_L84F_A106V_D108N_H123Y_S146C_D147Y_E155V_I156F_K157N)-
(SGGS)2-XTEN-(SGGS)2_nCas9_SGGS_NLS (SEQ ID NO: 475)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRSIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV*

ABE7.8 ecTadA(wild-type)-(SGGS)2-XTEN-(SGGS)2-
ecTadA(W23L_H36L_P48A_R51L_L84F_A106V_D108N_H123Y_A142N_S146C_D147Y_E155V_
I156F_K157N)-(SGGS)2-XTEN-(SGGS)2_nCas9_SGGS_NLS (SEQ ID NO: 476)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV*

ABE7.9 ecTadA(wild-type)-(SGGS)2-XTEN-(SGGS)2-
ecTadA(W23L_H36L_P48A_R51L_L84F_A106V_D108N_H123Y_A142N_S146C_D147Y_R152P¬_
E155V_I156F_K157N)-(SGGS)2-XTEN-(SGGS)2_nCas9_SGGS_NLS (SEQ ID NO: 477)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRALDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

-continued

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV*

ABE7.10 ecTadA(wild-type)-(SGGS)2-XTEN-(SGGS)2-
ecTadA(W23R_H36L_P48A_R51L_L84F_A106V_D108N_H123Y_S146C_D147Y_R152P¬1_
E155V_I156F_K157N)-(SGGS)2-XTEN-(SGGS)2_nCas9_SGGS_NLS (SEQ ID NO: 478)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGLVMQNYRLIDATLYVTFEP

CVMCAGAMIHSRIGRVVFGVRNAKTGAAGSLMDVLHYPGMNHRVEITEGILADECAALLCYFFRMPRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLIYLALAHMIKFRGHFLIEGDLNPD

NSDVDKLFIQLVQTYNQLFEENPINASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILLSDILRVNTEITKAPLSASMIKR

YDEHHQDLTLLKALVRQQLPEKYKEIFFDQSKNGYAGYIDGGASQEEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKSE

ETITPWNFEEVVDKGASAQSFIERMTNFDKNLPNEKVLPKHSLLYEYFTVYNELTKVKYVTEGMRKPAFLSG

EQKKAIVDLLFKTNRKVTVKQLKEDYFKKIECFDSVEISGVEDRFNASLGTYHDLLKIIKDKDFLDNEENEDIL

EDIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVKVITLKSKLVSDFRKDFQFYKVRE

INNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKKD

LIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLTNLGAPAAFKYFDTTIDRKRYTSTK

EVLDATLIHQSITGLYETRIDLSQLGGDSGGSPKKKRKV*

ABE6.4: ecTadA(wild-type)-(SGGS)2-XTEN-(SGGS)2-
ecTadA(H36L_P48S_R51L_L84F_A106V_D108N_H123Y_A142N_S146C_D147Y_E155V_I156F_
K157N)-(SGGS)2-XTEN-(SGGS)2_nCas9_SGGS_NLS (SEQ ID NO: 480)

MSEVEFSHEYWMRHALTLAKRAWDEREVPVGAVLVHNNRVIGEGWNRPIGRHDPTAHAEIMALRQGGLV

MQNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTDSGGSSGGSSGSETPGTSESATPESSGGSSGGSSEVEFSHEYWMRHA

LTLAKRAWDEREVPVGAVLVLNNRVIGEGWNRSIGLHDPTAHAEIMALRQGGLVMQNYRLIDATLYVTFEP

CVMCAGAMIHSRIGRVVFGVRNAKTGAAGSLMDVLHYPGMNHRVEITEGILADECNALLCYFFRMRRQVF

NAQKKAQSSTDSGGSSGGSSGSETPGTSESATPESSGGSSGGSDKKYSIGLAIGTNSVGWAVITDEYKVPSKK

FKVLGNTDRHSIKKNLIGALLFDSGETAEATRLKRTARRRYTRRKNRICYLQEIFSNEMAKVDDSFFHRLEES

-continued

FLVEEDKKHERHPIFGNIVDEVAYHEKYPTIYHLRKKLVDSTDKADLRLIYLALAHMIKFRGHFLIEGDLNPD
NSDVDKLFIQLVQTYNQLFEENPINASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQEEFYKFIKPILEKMDGTEELLVKLNRE
DLLRKQRTFDNGSIPHQIHLGELHAILRRQEDFYPFLKDNREKIEKILTFRIPYYVGPLARGNSRFAWMTRKSE
ETITPWNFEEVVDKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDKDFLDNEENEDIL
EDIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVIE
MARENQTTQKGQKNSRERMKRIEEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVKVITLKSKLVSDFRKDFQFYKVRE
INNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSSFEKNPIDFLEAKGYKEVKKD
LIIKLPKYSLFELENGRKRMLASAGELQKGNELALPSKYVNFLYLASHYEKLKGSPEDNEQKQLFVEQHKHY
LDEIIEQISEFSKRVILADANLDKVLSAYNKHRDKPIREQAENIIHLFTLTNLGAPAAFKYFDTTIDRKRYTSTK
EVLDATLIHQSITGLYETRIDLSQLGGDSGGSPKKKRKV

ABEmax (SEQ ID NO: 483)

MKRTADGSEFESPKKKRKVMSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIGRVVFGARDAKTGAAGSLMDV
LHHPGMNHRVEITEGILADECAALLSDFFRMRRQEIKAQKKAQSSTDSGGSSGGSSGSETPGTSESATPESSG
GSSGGSSEVEFSHEYWMRHALTLAKRARDEREVPVGAVLVLNNRVIGEGWNRAIGLHDPTAHAEIMALRQG
GLVMQNYRLIDATLYVTFEPCVMCAGAMIHSRIGRVVFGVRNAKTGAAGSLMDVLHYPGMNHRVEITEGIL
ADECAALLCYFFRMPRQVFNAQKKAQSSTDSGGSSGGSSGSETPGTSESATPESSGGSSGGSDKKYSIGLAIG
TNSVGWAVITDEYKVPSKKFKVLGNTDRHSIKKNLIGALLFDSGETAEATRLKRTARRRYTRRKNRICYLQEI
FSNEMAKVDDSFFHRLEESFLVEEDKKHERHPIFGNIVDEVAYHEKYPTIYHLRKKLVDSTDKADLRLIYLAL
AHMIKFRGHFLIEGDLNPDNSDVDKLFIQLVQTYNQLFEENPINASGVDAKAILSARLSKSRRLENLIAQLPGE
KKNGLFGNLIALSLGLTPNFKSNFDLAEDAKLQLSKDTYDDDLDNLLAQIGDQYADLFLAAKNLSDAILLSDI
LRVNTEITKAPLSASMIKRYDEHHQDLTLLKALVRQQLPEKYKEIFFDQSKNGYAGYIDGGASQEEFYKFIKPI
LEKMDGTEELLVKLNREDLLRKQRTFDNGSIPHQIHLGELHAILRRQEDFYPFLKDNREKIEKILTFRIPYYVG
PLARGNSRFAWMTRKSEETITPWNFEEVVDKGASAQSFIERMTNFDKNLPNEKVLPKHSLLYEYFTVYNELT
KVKYVTEGMRKPAFLSGEQKKAIVDLLFKTNRKVTVKQLKEDYFKKIECFDSVEISGVEDRFNASLGTYHDL
LKIIKDKDFLDNEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPAIKKGILQTVKV
VDELVKVMGRHKPENIVIEMARENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKNRGKSDNVPSEEVVKKMKNYWRQ
LLNAKLITQRKFDNLTKAERGGLSELDKAGFIKRQLVETRQITKHVAQILDSRMNTKYDENDKLIREVKVITL
KSKLVSDFRKDFQFYKVREINNYHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGRDFATVRKVLSMPQVNIVKKTEVQT

-continued

GGFSKESILPKRNSDKLIARKKDWDPKKYGGFDSPTVAYSVLVVAKVEKGKSKKLKSVKELLGITIMERSSFE

KNPIDFLEAKGYKEVKKDLIIKLPKYSLFELENGRKRMLASAGELQKGNELALPSKYVNFLYLASHYEKLKG

SPEDNEQKQLFVEQHKHYLDEIIEQISEFSKRVILADANLDKVLSAYNKHRDKPIREQAENIIHLFTLTNLGAP

AAFKYFDTTIDRKRYTSTKEVLDATLIHQSITGLYETRIDLSQLGGDKRTADGSEFEPKKKRKV

ABE8e (monomer)

(SEQ ID NO: 379)

MKRTADGSEFESPKKKRKVSEVEFSHEYWMRHALTLAKRARDEREVPVGAVLVLNNRVIGEGW

NRAIGLHDPTAHAEIMALRQGGLVMQNYRLIDATLYVTFEPCVMCAGAMIHSRIGRVVFGVRNSK

RGAAGSLMNVLNYPGMNHRVEITEGILADECAALLCDFYRMPRQVFNAQKKAQSSINSGGSSGGS

SGSETPGTSESATPESSGGSSGGSDKKYSIGLAIGTNSVGWAVITDEYKVPSKKFKVLGNTDRHSIK

KNLIGALLFDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGHFLIEGDLNP

DNSDVDKLFIQLVQTYNQLFEENPINASGVDAKAILSARLSKSRRLENLIAQLPGEKKNGLFGNLIA

LSLGLTPNFKSNFDLAEDAKLQLSKDTYDDDLDNLLAQIGDQYADLFLAAKNLSDAILLSDILRVN

TEITKAPLSASMIKRYDEHHQDLTLLKALVRQQLPEKYKEIFFDQSKNGYAGYIDGGASQEEFYKFI

KPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTVKQLKEDYFKKIECF

DSVEISGVEDRFNASLGTYHDLLKIIKDKDFLDNEENEDILEDIVLTLTLFEDREMIEERLKTYAHLF

DDKVMKQLKRRRYTGWGRLSRKLINGIRDKQSGKTILDFLKSDGFANRNFMQLIHDDSLTFKEDI

QKAQVSGQGDSLHEHIANLAGSPAIKKGILQTVKVVDELVKVMGRHKPENIVIEMARENQTTQKG

QKNSRERMKRIEEGIKELGSQILKEHPVENTQLQNEKLYLYYLQNGRDMYVDQELDINRLSDYDV

DHIVPQSFLKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRMLASAGELQKGNELALPSK

YVNFLYLASHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYETRIDLSQLG

GDSGGSKRTADGSEFEPKKKRKV

ABE8e (dimer)

(SEQ ID NO: 380)

MKRTADGSEFESPKKKRKVSEVEFSHEYWMRHALTLAKRAWDEREVPVGAVLVHNNRVIGEGW

NRPIGRHDPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTDSGGSSGG

SSGSETPGTSESATPESSGGSSGGSSEVEFSHEYWMRHALTLAKRARDEREVPVGAVLVLNNRVIG

EGWNRAIGLHDPTAHAEIMALRQGGLVMQNYRLIDATLYVTFEPCVMCAGAMIHSRIGRVVFGV

RNSKRGAAGSLMNVLNYPGMNHRVEITEGILADECAALLCDFYRMPRQVFNAQKKAQSSINSGG

SSGGSSGSETPGTSESATPESSGGSSGGSDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLPGEKKNGLFG

-continued

NLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNRE

KIEKILTFRIPYYVGPLARGNSRFAWMTRKSEETITPWNFEEVVDKGASAQSFIERMTNFDKNLPNE

KVLPKHSLLYEYFTVYNELTKVKYVTEGMRKPAFLSGEQKKAIVDLLFKTNRKVTVKQLKEDYF

KKIECFDSVEISGVEDRFNASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSKLV

SDFRKDFQFYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRKVLSMPQVNI

VKKTEVQTGGFSKESILPKRNSDKLIARKKDWDPKKYGGFDSPTVAYSVLVVAKVEKGKSKKLKS

VKELLGITIMERSSFEKNPIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRID

LSQLGGDSGGSKRTADGSEFEPKKKRKV

SaABE8e (SEQ ID NO: 381)

MKRTADGSEFESPKKKRKVSEVEFSHEYWMRHALTLAKRARDEREVPVGAVLVLNNRVIGEGW

NRAIGLHDPTAHAEIMALRQGGLVMQNYRLIDATLYVTFEPCVMCAGAMIHSRIGRVVFGVRNSK

RGAAGSLMNVLNYPGMNHRVEITEGILADECAALLCDFYRMPRQVFNAQKKAQSSINSGGSSGGS

SGSETPGTSESATPESSGGSSGGSGKRNYILGLAIGITSVGYGIIDYETRDVIDAGVRLFKEANVENN

EGRRSKRGARRLKRRRRHRIQRVKKLLFDYNLLTDHSELSGINPYEARVKGLSQKLSEEEFSAALL

HLAKRRGVHNVNEVEEDTGNELSTKEQISRNSKALEEKYVAELQLERLKKDGEVRGSINRFKTSD

YVKEAKQLLKVQKAYHQLDQSFIDTYIDLLETRRTYYEGPGEGSPFGWKDIKEWYEMLMGHCTY

FPEELRSVKYAYNADLYNALNDLNNLVITRDENEKLEYYEKFQIIENVFKQKKKPTLKQIAKEILV

NEEDIKGYRVTSTGKPEFTNLKVYHDIKDITARKEIIENAELLDQIAKILTIYQSSEDIQEELTNLNSE

LTQEEIEQISNLKGYTGTHNLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMINEMQKRNRQTNERIEEIIRTT

GKENAKYLIEKIKLHDMQEGKCLYSLEAIPLEDLLNNPFNYEVDHIIPRSVSFDNSFNNKVLVKQEE

NSKKGNRTPFQYLSSSDSKISYETFKKHILNLAKGKGRISKTKKEYLLEERDINRFSVQKDFINRNL

VDTRYATRGLMNLLRSYFRVNNLDVKVKSINGGFTSFLRRKWKFKKERNKGYKHHAEDALIIAN

ADFIFKEWKKLDKAKKVMENQMFEEKQAESMPEIETEQEYKEIFITPHQIKHIKDFKDYKYSHRVD

KKPNRELINDTLYSTRKDDKGNTLIVNNLNGLYDKDNDKLKKLINKSPEKLLMYHHDPQTYQKL

KLIMEQYGDEKNPLYKYYEETGNYLTKYSKKDNGPVIKKIKYYGNKLNAHLDITDDYPNSRNKV

VKLSLKPYRFDVYLDNGVYKFVTVKNLDVIKKENYYEVNSKCYEEAKKLKKISNQAEFIASFYNN

DLIKINGELYRVIGVNNDLLNRIEVNMIDITYREYLENMNDKRPPRIIKTIASKTQSIKKYSTDILGNL

YEVKSKKHPQIIKKGSGGSKRTADGSEFEPKKKRKV

-continued

SpCas9NG-ABE8e ("ABE8e-NG")

(SEQ ID NO: 382)

MKRTADGSEFESPKKKRKVSEVEFSHEYWMRHALTLAKRARDEREVPVGAVLVLNNRVIGEGWN
RAIGLHDPTAHAEIMALRQGGLVMQNYRLIDATLYVTFEPCVMCAGAMIHSRIGRVVFGVRNSKRGA
AGSLMNVLNYPGMNHRVEITEGILADECAALLCDFYRMPRQVFNAQKKAQSSINSGGSSGGSSGS
ETPGTSESATPESSGGSSGGSDKKYSIGLAIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEGDLNPDNSD
VDKLFIQLVQTYNQLFEENPINASGVDAKAILSARLSKSRRLENLIAQLPGEKKNGLFGNLIALSLGL
TPNFKSNFDLAEDAKLQLSKDTYDDDLDNLLAQIGDQYADLFLAAKNLSDAILLSDILRVNTEITKA
PLSASMIKRYDEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDKNLPNEKVLPKHSLLY
EYFTVYNELTKVKYVTEGMRKPAFLSGEQKKAIVDLLFKTNRKVTVKQLKEDYFKKIECFDSVEIS
GVEDRFNASLGTYHDLLKIIKDKDFLDNEENEDILEDIVLTLTLFEDREMIEERLKTYAHLFDDKVM
KQLKRRRYTGWGRLSRKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMARENQTTQKGQKNSRE
RMKRIEEGIKELGSQILKEHPVENTQLQNEKLYLYYLQNGRDMYVDQELDINRLSDYDVDHIVPQS
FLKDDSIDNKVLTRSDKNRGKSDNVPSEEVVKKMKNYWRQLLNAKLITQRKFDNLTKAERGGLS
ELDKAGFIKRQLVETRQITKHVAQILDSRMNTKYDENDKLIREVKVITLKSKLVSDFRKDFQFYKV
REINNYHHAHDAYLNAVVGTALIKKYPKLESEFVYGDYKVYDVRKMIAKSEQEIGKATAKYFFYS
NIMNFFKTEITLANGEIRKRPLIETNGETGEIVWDKGRDFATVRKVLSMPQVNIVKKTEVQTGGFSKEST
RPKRNSDKLIARKKDWDPKKYGGFVSPTVAYSVLVVAKVEKGKSKKLKSVKELLGITIMERSSFE
KNPIDFLEAKGYKEVKKDLIIKLPKYSLFELENGRKRMLASARFLQKGNELALPSKYVNFLYLASH
YEKLKGSPEDNEQKQLFVEQHKHYLDEIIEQISEFSKRVILADANLDKVLSAYNKHRDKPIREQAE
NIIHLFTLTNLGAPRAFKYFDTTIDRKVYRSTKEVLDATLIHQSITGLYETRIDLSQLGGDSGGSKRT
ADGSEFEPKKKRKV

SaKKH-ABE8e ("ABE8e-KKH")

(SEQ ID NO: 383)

MKRTADGSEFESPKKKRKVSEVEFSHEYWMRHALTLAKRARDEREVPVGAVLVLNNRVIGEGW
NRAIGLHDPTAHAEIMALRQGGLVMQNYRLIDATLYVTFEPCVMCAGAMIHSRIGRVVFGVRNSK
RGAAGSLMNVLNYPGMNHRVEITEGILADECAALLCDFYRMPRQVFNAQKKAQSSINSGGSSGGS
SGSETPGTSESATPESSGGSSGGSGKRNYILGLAIGITSVGYGIIDYETRDVIDAGVRLFKEANVENN
EGRRSKRGARRLKRRRRHRIQRVKKLLFDYNLLTDHSELSGINPYEARVKGLSQKLSEEEFSAALL
HLAKRRGVHNVNEVEEDTGNELSTKEQISRNSKALEEKYVAELQLERLKKDGEVRGSINRFKTSD
YVKEAKQLLKVQKAYHQLDQSFIDTYIDLLETRRTYYEGPGEGSPFGWKDIKEWYEMLMGHCTY
FPEELRSVKYAYNADLYNALNDLNNLVITRDENEKLEYYEKFQIIENVFKQKKKPTLKQIAKEILV
NEEDIKGYRVTSTGKPEFTNLKVYHDIKDITARKEIIENAELLDQIAKILTIYQSSEDIQEELTNLNSE
LTQEEIEQISNLKGYTGTHNLSLKAINLILDELWHTNDNQIAIFNRLKLVPKKVDLSQQKEIPTTLVD
DFILSPVVKRSFIQSIKVINAIIKKYGLPNDIIIELAREKNSKDAQKMINEMQKRNRQTNERIEEIIRTT
GKENAKYLIEKIKLHDMQEGKCLYSLEAIPLEDLLNNPFNYEVDHIIPRSVSFDNSFNNKVLVKQEE
NSKKGNRTPFQYLSSSDSKISYETFKKHILNLAKGKGRISKTKKEYLLEERDINRFSVQKDFINRNL

-continued

VDTRYATRGLMNLLRSYFRVNNLDVKVKSINGGFTSFLRRKWKFKKERNKGYKHHAEDALIIAN

ADFIFKEWKKLDKAKKVMENQMFEEKQAESMPEIETEQEYKEIFITPHQIKHIKDFKDYKYSHRVD

KKPNRKLINDTLYSTRKDDKGNTLIVNNLNGLYDKDNDKLKKLINKSPEKLLMYHHDPQTYQKL

KLIMEQYGDEKNPLYKYYEETGNYLTKYSKKDNGPVIKKIKYYGNKLNAHLDITDDYPNSRNKV

VKLSLKPYRFDVYLDNGVYKFVTVKNLDVIKKENYYEVNSKCYEEAKKLKKISNQAEFIASFYKN

DLIKINGELYRVIGVNNDLLNRIEVNMIDITYREYLENMNDKRPPHIIKTIASKTQSIKKYSTDILGNL

YEVKSKKHPQIIKKGSGGSKRTADGSEFEPKKKRKV

ABE8-NRTH: NLS TadA linker, TadA, NRTH (SEQ ID NO: 553)

MKRTADGSEFESPKKKRKVSEVEFSHEYWMRHALTLAKRARDEREVPVGAVLVLNNRVIGEGW

NRAIGLHDPTAHAEIMALRQGGLVMQNYRLIDATLYVTFEPCVMCAGAMIHSRIGRVVFGVRNSK

RGAAGSLMNVLNYPGMNHRVEITEGILADECAALLCDFYRMPRQVFNAQKKAQSSINSGGSSGGS

SGSETPGTSESATPESSGGSSGGS*SEVEFSHEYWMRHALTLAKRARDEREVPVGAVLVLNNRVIGEGWN*

*RAIGLHDPTAHAEIMALRQGGLVMQNYRLIDATLYVTFEPCVMCAGAMIHSRIGRVVFGVRNSKRGAAG*

*SLMNVLNYPGMNHRVEITEGILADECAALLCDFYRMPRQVFNAQKKAQSSINSGGSSGGSSGSETPGTS*

*ESATPESSGGSSGGSDKKYSIGLTIGTNSVGWAVITDEYKVPSKKFKVLGNTDRHSIKKNLIGALLFDSGE*

*TAEATRLKRTARRRYTRRKNRICYLQEIFSNEMAKVDDSFFHRLEESFLVEEDKKHERHPIFGNIVDEVAY*

*HEKYPTIYHLRKKLVDSTDKADLRLIYLALAHMIKFRGHFLIEGDLNPDNSDVDKLFIQLVQTYNQLFEE*

*NPINASGVDAKAILSARLSKSRRLENLIAQLPGEKKNGLFGNLIALSLGLTPNFKSNFDLAEDAKLQLSKD*

*TYDDDLDNLLAQIGDQYADLFLAAKNLSDAILLSDILRVNTEITKAPLSASMVKRYDEHHQDLTLLKALVR*

*QQLPEKYKEIFFDQSKNGYAGYIDGGASQEEFYKFIKPILEKMDGTEELLVKLNREDLLRKQRTFDNGII*

*PHQIHLGELHAILRRQGDFYPFLKDNREKIEKILTFRIPYYVGPLARGNSRFAWMTRKSEETITPWNFEEV*

*VDKGASAQSFIERMTNFDKNLPNEKVLPKHSLLYEYFTVYNELTKVKYVTEGMRKPAFLSGEQKKAIVDL*

*LFKTNRKVTVKQLKEDYFKKIECFDSVEISGVEDRFNASLGTYHDLLKIIKDKDFLDNEENEDILEDIVLT*

*LTLFEDREMIEERLKTYAHLFDDKVMKQLKRLRYTGWGRLSRKLINGIRDKQSGKTILDFLKSDGFANR*

*NFMQLIHDDSLTFKEDIQKAQVSCQGDSLHEHIANLAGSPAIKKGILQTVKVVDELVKVMGGHKPENIVI*

*EMARENQTTQKGQKNSRERMKRIEEGIKELGSQILKEHPVENTQLQNEKLYLYYLQNGRDMYVDQELDI*

*NRLSDYDVDHIVPQSFLKDDSIDNKVLTRSDKNRGKSDNVPSEEVVKKMKNYWRQLLNAKLITQRKFDN*

*LTKAERGGLSELDKAGFIKRQLVETRQITKHVAQILDSRMNTKYDENDKLIREVKVITLKSKLVSDFRKDF*

*QFYKVREINNYHHAHDAYLNAVVGTALIKKYPKLESEFVYGDYKVYDVRKMIAKSEQEIGKATAKYFFYS*

*NIMNFFKTEITLANGEIRKRPLIETNGETGEIVWDKGRDFATVRKVLSMPQVNIVKKTEVQTGGFSKESIL*

*PKGNSDKLIARKKDWDPKKYGGFNSPTVAYSVLVVAKVEKGKSKKLKSVKELLGITIMERSSFEKNPIGF*

*LEAKGYKEVKKDLIIKLPKYSLFELENGRKRMLASASVLHKGNELALPSKYVNFLYLASHYEKLKGSSEDN*

*KQKQLFVEQHKHYLDEHEQISEFSKRVILADANLDKVLSAYNKHRDKPIREQAENIIHLFTLTNLGASAAF*

*KYFDTTIGRKLYTSTKEVLDATLIHQSITGLYETRIDLSQLGGD*SGGSKRTADGSEFEPKKKRKV

ABE8-NRRH: NLS TadA linker, TadA, NRRH (SEQ ID NO: 385)

MKRTADGSEFESPKKKRKVSEVEFSHEYWMRHALTLAKRARDEREVPVGAVLVLNN

RVIGEGWNRAIGLHDPTAHAEIMALRQGGLVMQNYRLIDATLYVTFEPCVMCAGA

MIHSRIGRVVFGVRNSKRGAAGSLMNVLNYPGMNHRVEITEGILADECAALLCDFY

RMPRQVFNAQKKAQSSINSGGSSGGSSGSETPGTSESATPESSGGSSGGS*SEVEFSHEYWM*

*RHALTLAKRARDEREVPVGAVLVLNNRVIGEGWNRAIGLHDPTAHAEIMALRQGGLVMQNYRL*

*IDATLYVTFEPCVMCAGAMIHSRIGRVVFGVRNSKRGAAGSLMNVLNYPGMNHRVEITEGILAD*

-continued

*ECAALLCDFYRMPRQVFNAQKKAQSSIN*SGGSSGGSSGSETPGTSESATPESSGGSSGGS*DKK*

*YSIGLTIGTNSVGWAVITDEYKVPSKKFKVLGNTDRHSIKKNLIGALLFDSGETAEATRLKRTARR*

*RYTRRKNRICYLQEIFSNEMAKVDDSFFHRLEESFLVEEDKKHERHPIFGNIVDEVAYHEKYPTI*

*YHLRKKLVDSTDKADLRLIYLALAHMIKFRGHFLIEGDLNPDNSDVDKLFIQLVQTYNQLFEEN*

*PINASGVDAKAILSARLSKSRRLENLIAQLPGEKKNGLFGNLIALSLGLTPNFKSNFDLAEDAKLQ*

*LSKDTYDDDLDNLLAQIGDQYADLFLAAKNLSDAILLSDILRVNTEITKAPLSASMVKRYDEHHQ*

*DLTLLKALVRQQLPEKYKEIFFDQSKNGYAGYIDGGASQEEFYKFIKPILEKMDGTEELLVKLN*

*REDLLRKQRTFDNGIIPHQIHLGELHAILRRQGDFYPFLKDNREKIEKILTFRIPYYVGPLARGNS*

*RFAWMTRKSEETITPWNFEEVVDKGASAQSFIERMTNFDKNLPNEKVLPKHSLLYEYFTVYNEL*

*TKVKYVTEGMRKPAFLSGEQKKAIVDLLFKTNRKVTVKQLKEDYFKKIECFDSVEISGVEDRFN*

*ASLGTYHDLLKIIKDKDFLDNEENEDILEDIVLTLTLFEDREMIEERLKTYAHLFDDKVMKQLKR*

*LRYTGWGRLSRKLINGIRDKQSGKTILDFLKSDGFANRNFMQLIHDDSLTFKEDIQKAQVSCQG*

*DSLHEHIANLAGSPAIKKGILQTVKVVDELVKVMGGHKPENIVIEMARENQTTQKGQKNSRER*

*MKRIEEGIKELGSQILKEHPVENTQLQNEKLYLYYLQNGRDMYVDQELDINRLSDYDVDHIVPQ*

*SFLKDDSIDNKVLTRSDKNRGKSDNVPSEEVVKKMKNYWRQLLNAKLITQRKFDNLTKAERGG*

*LSELDKAGFIKRQLVETRQITKHVAQILDSRMNTKYDENDKLIREVKVITLKSKLVSDFRKDFQF*

*YKVREINNYHHAHDAYLNAVVGTALIKKYPKLESEFVYGDYKVYDVRKMIAKSEQEIGKATAKYF*

*FYSNIMNFFKTEITLANGEIRKRPLIETNGETGEIVWDKGRDFATVRKVLSMPQVNIVKKTEVQT*

*GGFSKESILPKGNSDKLIARKKDWDPKKYGGFNSPTAAYSVLVVAKVEKGKSKKLKSVKELLGIT*

*IMERSSFEKNPIGFLEAKGYKEVKKDLIIKLPKYSLFELENGRKRMLASAGVLHKGNELALPSKY*

*VNFLYLASHYEKLKGSPEDNEQKQLFVEQHKHYLDEIIEQISEFSKRVILADANLDKVLSAYNKH*

*RDKPIREQAENIIHLFTLTNLGVPAAFKYFDTTIDKKRYTSTKEVLDATLIHQSITGLYETRIDLSQ*

*LGGD*SGGSKRTADGSEFEPKKKRKV xCas9(3.7)-ABE(7.10): (ecTadA(wt)-linker(32 aa)-ecTadA*(7.10)-linker(32 aa)-nxCas9(3.7)-NLS):

(SEQ ID NO: 386)

*MSEVEFSHEYWMRHALTLAKRAWDEREVPVGAVLVHNNRVIGEGWNRPIGRHDPTAHA*

*EIMALRQGGLVMQNYRLIDATLYVTLEPCVMCAGAMIHSRIGRVVFGARDAKTGAAGSL*

*MDVLHHPGMNHRVEITEGILADECAALLSDFFRMRRQEIKAQKKAQSSTD* *SGGSSGGSS*

*GSETPGTSESATPESSGGSSGGS* *SEVEFSHEYWMRHALTLAKRARDEREVPVGAVLVLNNRVI*

*GEGWNRAIGLHDPTAHAEIMALRQGGLVMQNYRLIDATLYVITEPCVMCAGAMIHSRIGRVVF*

*GVRNAKTGAAGSLMDVLHYPGMNHRVEITEGILADECAALLCYFFRMPRQVFNAQKKAQSSTD*

*SGGSSGGSSGSETPGTSESATPESSGGSSGGS*DKKYSIGLAIGTNSVGWAVITDEYKVPSK

KFKVLGNTDRHSIKKNLIGALLFDSGETAEATRLKRTARRYTRRKNRICYLQEIFSNEMA

KVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINTASGVDAKAILSA

RLSKSRRLENLIAQLPGEKKNGLFGNLIALSLGLTPNFKSNFDLAEDTKLQLSKDTYDDDL

DNLLAQIGDQYADLFLAAKNLSDAILLSDILRVNTEITKAPLSASMIKLYDEHHQDLTLLK

ALVRQQLPEKYKEIFFDQSKNGYAGYIDGGASQEEFYKFIKPILEKMDGTEELLVKLNRED

LLRKQRTFDNGIIPHQIHLGELHAILRRQEDFYPFLKDNREKIEKILTFRIPYYVGPLARGNS

RFAWMTRKSEETITPWNFEKVVDKGASAQSFIERMTNFDKNLPNEKVLPKHSLLYEYFTV

-continued

YNELTKVKYVTEGMRKPAFLSGDQKKAIVDLLFKTNRKVTVKQLKEDYFKKIECFDSVET

SGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFIQLIHDDSL

TFKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRD

MYVDQELDINRLSDYDVDHIVPQSFLKDDSIDNKVLTRSDKNRGKSDNVPSEEVVKKMK

NYWRQLLNAKLITQRKFDNLTKAERGGLSELDKAGFIKRQLVETRQITKHVAQILDSRMN

TKYDENDKLIREVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEITLANGEIRKRP

LIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFL

EAKGYKEVKKDLIIKLPKYSLFELENGRKRMLASAGVLQKGNELALPSKYVNFLYLASHY

EKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQLG

GD*EGADKRTADGSEFES*PKKKRKV

ABE8-VRQR: NLS TadA linker, TadA, SpCas9-VROR (SEQ ID NO: 387)

*MKRTADGSEFESPKKKRKV*SEVEFSHEYWMRHALTLAKRARDEREVPVGAVLVLNN

RVIGEGWNRAIGLHDPTAHAEIMALRQGGLVMQNYRLIDATLYVTFEPCVMCAGA

MIHSRIGRVVFGVRNSKRGAAGSLMNVLNYPGMNHRVEITEGILADECAALLCDFY

RMPRQVFNACIKKAQSSINSGGSSGGSSGSETPGTSESATPESSGGSSGGS*SEVEFSHEYWM*

*RHALTLAKRARDEREVPVGAVLVLNNRVIGEGWNRAIGLHDPTAHAEIMALRQGGLVMQNYRLI*

*DATLYVTFEPCVMCAGAMIHSRIGRVVFGVRNSKRGAAGSLMNVLNYPGMNHRVEITEGILADE*

*CAALLCDFYRMPRQVFNAQKKAQSSINSGGSSGGSSGSETPGTSESATPESSGGSSGGSDKKY*

*SIGLAIGTNSVGWAVITDEYKVPSKKFKVLGNTDRHSIKKNLIGALLFDSGETAEATRLKRTARRR*

*YTRRKNRICYLQEIFSNEMAKVDDSFFHRLEESFLVEEDKKHERHPIFGNIVDEVAYHEKYPTIY*

*HLRKKLVDSTDKADLRLIYLALAHMIKFRGHFLIEGDLNPDNSDVDKLFIQLVQTYNQLFEENPI*

*NASGVDAKAILSARLSKSRRLENLIAQLPGEKKNGLFGNLIALSLGLTPNFKSNFDLAEDAKLQL*

*SKDTYDDDLDNLLAQIGDQYADLFLAAKNLSDAILLSDILRVNTEITKAPLSASMIKRYDEHHQD*

*LTLLKALVRQQLPEKYKEIFFDQSKNGYAGYIDGGASQEEFYKFIKPILEKMDGTEELLVKLNRE*

*DLLRKQRTFDNGSIPHQIHLGELHAILRRQEDFYPFLKDNREKIEKILTFRIPYYVGPLARGNSR*

*FAWMTRKSEETITPWNFEEVVDKGASAQSFIERMTNFDKNLPNEKVLPKHSLLYEYFTVYNELT*

*KVKYVTEGMRKPAFLSGEQKKAIVDLLFKTNRKVTVKQLKEDYFKKIECFDSVEISGVEDRFNA*

*SLGTYHDLLKIIKDKDFLDNEENEDILEDIVLTLTLFEDREMIEERLKTYAHLFDDKVMKQLKRR*

*RYTGWGRLSRKLINGIRDKQSGKTILDFLKSDGFANRNFMQLIHDDSLTFKEDIQKAQVSGQG*

*DSLHEHIANLAGSPAIKKGILQTVKVVDELVKVMGRHKPENIVIEMARENQTTQKGQKNSRERM*

*KRIEEGIKELGSQILKEHPVENTQLQNEKLYLYYLQNGRDMYVDQELDINRLSDYDVDHIVPQS*

*FLKDDSIDNKVLTRSDKNRGKSDNVPSEEVVKKMKNYWRQLLNAKLITQRKFDNLTKAERGGL*

*SELDKAGFIKRQLVETRQITKHVAQILDSRMNTKYDENDKLIREVKVITLKSKLVSDFRKDFQFY*

*KVREINNYHHAHDAYLNAVVGTALIKKYPKLESEFVYGDYKVYDVRKMIAKSEQEIGKATAKYFF*

*YSNIMNFFKTEITLANGEIRKRPLIETNGETGEIVWDKGRDFATVRKVLSMPQVNIVKKTEVQTG*

*GFSKESILPKRNSDKLIARKKDWDPKKYGGFVSPTVAYSVLVVAKVEKGKSKKLKSVKELLGITI*

-continued

*MERSSFEKNPIDFLEAKGYKEVKKDLIIKLPKYSLFELENGRKRMLASARELQKGNELALPSKYV*

*NFLYLASHYEKLKGSPEDNEQKQLFVEQHKHYLDEIIEQISEFSKRVILADANLDKVLSAYNKHR*

*DKPIREQAENIIHLFTLTNLGAPAAFKYFDTTIDRKQYRSTKEVLDATLIHQSITGLYETRIDLSQL*

*GGD*SGGSKRTADGSEFEPKKKRKV

ABE8e(TadA-8e V106W)

(SEQ ID NO: 388)

MKRTADGSEFESPKKKRKVSEVEFSHEYWMRHALTLAKRARDEREVPVGAVLVLNNRVIGEGW

NRAIGLHDPTAHAEIMALRQGGLVMQNYRLIDATLYVTFEPCVMCAGAMIHSRIGRVVFGWRNS

KRGAAGSLMNVLNYPGMNHRVEITEGILADECAALLCDFYRMPRQVFNAQKKAQSSINSGGSSG

GSSGSETPGTSESATPESSGGSSGGSDKKYSIGLAIGTNSVGWAVITDEYKVPSKKFKVLGNTDRHS

IKKNLIGALLFDSGETAEATRLKRTARRRYTRRKNRICYLQEIFSNEMAKVDDSFFHRLEESFLVEE

DKKHERHPIFGNIVDEVAYHEKYPTIYHLRKKLVDSTDKADLRLIYLALAHMIKFRGHFLIEGDLN

PDNSDVDKLFIQLVQTYNQLFEENPINASGVDAKAILSARLSKSRRLENLIAQLPGEKKNGLFGNLI

ALSLGLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAILRRQEDFYPFLKDNREKIEK

ILTFRIPYYVGPLARGNSRFAWMTRKSEETITPWNFEEVVDKGASAQSFIERMTNFDKNLPNEKVL

PKHSLLYEYFTVYNELTKVKYVTEGMRKPAFLSGEQKKAIVDLLFKTNRKVTVKQLKEDYFKKIE

CFDSVEISGVEDRFNASLGTYHDLLKIIKDKDFLDNEENEDILEDIVLTLTLFEDREMIEERLKTYAH

LFDDKVMKQLKRRRYTGWGRLSRKLINGIRDKQSGKTILDFLKSDGFANRNFMQLIHDDSLTFKE

DIQKAQVSGQGDSLHEHIANLAGSPAIKKGILQTVKVVDELVKVMGRHKPENIVIEMARENQTTQ

KGQKNSRERMKRIEEGIKELGSQILKEHPVENTQLQNEKLYLYYLQNGRDMYVDQELDINRLSDY

DVDHIVPQSFLKDDSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQVNIVK

KTEVQTGGFSKESILPKRNSDKLIARKKDWDPKKYGGFDSPTVAYSVLVVAKVEKGKSKKLKSVK

ELLGITIMERSSFEKNPIDFLEAKGYKEVKKDLIIKLPKYSLFELENGRKRMLASAGELQKGNELAL

PSKYVNFLYLASHYEKLKGSPEDNEQKQLFVEQHKHYLDEIIEQISEFSKRVILADANLDKVLSAY

NKHRDKPIREQAENIIHLFTLTNLGAPAAFKYFDTTIDRKRYTSTKEVLDATLIHQSITGLYETRIDL

SQLGGDSGGSKRTADGSEFEPKKKRKV

For the full AAV genome sequences with that encode the CBE3.9max and ABEmax nucleobase editor constructs used in Examples 4 and 5, described below, see FIGS. 26A-26U. All constructs cloned in the px601 backbone, and pseudospacer-containing backbones were cut with Esp3I/BsmBI endonucleases. Primers listed in FIGS. 25A-25B were annealed and ligated with standard molecular biology techniques. The U6-sgRNA cassette was omitted from the ABEmax N-terminal constructs to keep the total construct size under the maximum AAV particle packaging limit.

Uracil Glycosylase Inhibitor Domains

In some embodiments, the N-terminal portion of a split nucleobase editor further comprises an inhibitor of uracil glycosylase (UGI). In some embodiments, the first nucleotide sequence encodes a polypeptide of the structure: $NH_2$-[UGI]-[nucleobase modifying enzyme]-[N-terminal portion of dCas9 or nCas9]-[intein-N]. In some embodiments, the first nucleotide sequence encodes a polypeptide is of the structure: $NH_2$-[nucleobase modifying enzyme]-[UGI]-[N-terminal portion of dCas9 or nCas9]-[intein-N].

In some embodiments, the C-terminal portion of a split nucleobase editor further comprises an enzyme that inhibits the activity of uracil glycosylase (UGI). In some embodiments, the second nucleotide sequence encodes a polypeptide of the structure: $NH_2$-[intein-C]-[C-terminal portion of dCas9 or nCas9]-[UGI]-COOH. In some embodiments, the second nucleotide sequence encodes a polypeptide of the structure: $NH_2$-[intein-C]-[C-terminal portion of dCas9 or nCas9]-[nucleobase modifying enzyme]-[UGI]-COOH. In some embodiments, the second nucleotide sequence encodes a polypeptide of the structure: $NH_2$-[intein-C]-[C-terminal portion of dCas9 or nCas9]-[UGI]-[nucleobase modifying enzyme]-COOH.

Non-limiting, exemplary uracil glycosylase inhibitor sequences are provided below.

```
Bacillus phage PBS2 (Bacteriophage PBS2) Uracil-
DNA glycosylase inhibitor
                                    (SEQ ID NO: 299)
MTNLSDIIEKETGKQLVIQESILMLPEEVEEVIGNKPESDILVHTAYDE

STDENVMLLTSDAPEYKPWALVIQDSNGENKIKML

Erwinia tasmaniensis SSB (themostable single-
stranded DNA binding protein)
                                    (SEQ ID NO: 300)
MASRGVNKVILVGNLGQDPEVRYMPNGGAVANITLATSESWRDKQTGET

KEKTEWHRVVLFGKLAEVAGEYLRKGSQVYIEGALQTRKWTDQAGVEKY

TTEVVVNVGGTMQMLGGRSQGGGASAGGQNGGSNNGWGQPQQPQGGNQF

SGGAQQQARPQQQPQQNNAPANNEPPIDFDDDIP

UdgX (binds to uracil in DNA but does not excise)
                                    (SEQ ID NO: 301)
MAGAQDFVPHTADLAELAAAAGECRGCGLYRDATQAVFGAGGRSARIMM

IGEQPGDKEDLAGLPFVGPAGRLLDRALEAADIDRDALYVTNAVKHFKF

TRAAGGKRRIHKTPSRTEVVACRPWLIAEMTSVEPDVVVLLGATAAKAL

LGNDFRVTQHRGEVLHVDDVPGDPALVATVHPSSLLRGPKEERESAFAG

LVDDLRVAADVRP

UDG (catalytically inactive human UDG, binds to
uracil in DNA but does not excise)
                                    (SEQ ID NO: 302)
MIGQKTLYSFFSPSPARKRHAPSPEPAVQGTGVAGVPEESGDAAAIPAK

KAPAGQEEPGTPPSSPLSAEQLDRIQRNKAAALLRLAARNVPVGFGESW

KKHLSGEFGKPYFIKLMGFVAEERKHYTVYPPPHQVFTWTQMCDIKDVK

VVILGQEPYHGPNQAHGLCFSVQRPVPPPPSLENIYKELSTDIEDFVHP

GHGDLSGWAKQGVLLLNAVLTVRAHQANSHKERGWEQFTDAVVSWLNQN

SNGLVFLLWGSYAQKKGSAIDRKRHHVLQTAHPSPLSVYRGFFGCRHFS

KTNELLQKSGKKPIDWKEL
```

In some embodiments, when the N-terminal portion and the C-terminal portion of the nucleobase are joined, to form a complete split nucleobase editor. In some embodiments, the split nucleobase editor may comprise any one of the following structures:

- $NH_2$-[nucleobase modifying enzyme]-[dCas9 or nCas9]-COOH
- $NH_2$-[UGI]-[nucleobase modifying enzyme]-[dCas9 or nCas9]-COOH
- $NH_2$-[nucleobase modifying enzyme]-[UGI]-[dCas9 or nCas9]-COOH
- $NH_2$-[nucleobase modifying enzyme]-[dCas9 or nCas9]-[UGI]-COOH
- $NH_2$-[dCas9 or nCas9]-[nucleobase modifying enzyme]-COOH
- $NH_2$-[UGI]-[dCas9 or nCas9]-[nucleobase modifying enzyme]-COOH
- $NH_2$-[dCas9 or nCas9]-[UGI]-[nucleobase modifying enzyme]-COOH or
- $NH_2$-[dCas9 or nCas9]-[nucleobase modifying enzyme]-[UGI]-COOH.

In some embodiments, the first nucleotide sequence or the second nucleotide sequence (encoding either the split Cas9 protein or the split nucleobase editor) is operably linked to a nucleotide sequence encoding at least one bipartite nuclear localization signal (NLS). For example, the first nucleotide sequence may be operably linked to a nucleotide sequence encoding one or more (e.g., 2, 3, 4, 5, or more) bipartite NLS. In some embodiments, the second nucleotide sequence may be operably linked to a nucleotide sequence encoding one or more (e.g., 2, 3, 4, 5, or more) bipartite NLSs. As such, the split Cas9 or split nucleobase editor formed by joining the N-terminal portion and the C-terminal portion may comprise one or more bipartite NLSs. For example, the split Cas9 or split nucleobase editor may comprise any one of the following structures (bNLS means one or more bipartite nuclear localization signals):

- $NH_2$-bNLS-[Cas9]-COOH
- $NH_2$-[Cas9]-bNLS-COOH
- $NH_2$-bNLS-[nucleobase modifying enzyme]-[dCas9 or nCas9]-COOH
- $NH_2$-[nucleobase modifying enzyme]-bNLS-[dCas9 or nCas9]-COOH
- $NH_2$-[nucleobase modifying enzyme]-[dCas9 or nCas9]-bNLS-COOH
- $NH_2$-bNLS-[nucleobase modifying enzyme]-[dCas9 or nCas9]-bNLS-COOH
- $NH_2$-bNLS-[nucleobase modifying enzyme]-[dCas9 or nCas9]-COOH
- $NH_2$-bNLS-[nucleobase modifying enzyme]-bNLS-[dCas9 or nCas9]-bNLS-COOH
- $NH_2$-bNLS-[UGI]-[nucleobase modifying enzyme]-[dCas9 or nCas9]-COOH
- $NH_2$-[UGI]-bNLS-[nucleobase modifying enzyme]-[dCas9 or nCas9]-COOH
- $NH_2$-[UGI]-[nucleobase modifying enzyme]-bNLS [dCas9 or nCas9]-COOH
- $NH_2$-[UGI]-[nucleobase modifying enzyme]-[dCas9 or nCas9]-bNLS-COOH
- $NH_2$-bNLS-[UGI]-bNLS-[nucleobase modifying enzyme]-[dCas9 or nCas9]-COOH
- $NH_2$-bNLS-[UGI]-[nucleobase modifying enzyme]-bNLS-[dCas9 or nCas9]-COOH
- $NH_2$-bNLS-[UGI]-[nucleobase modifying enzyme]-[dCas9 or nCas9]-bNLS-COOH
- $NH_2$-[UGI]-bNLS-[nucleobase modifying enzyme]-bNLS-[dCas9 or nCas9]-COOH
- $NH_2$-[UGI]-bNLS-[nucleobase modifying enzyme]-[dCas9 or nCas9]-bNLS-COOH
- $NH_2$-[UGI]-[nucleobase modifying enzyme]-bNLS-[dCas9 or nCas9]-bNLS-COOH
- $NH_2$-bNLS-[UGI]-bNLS-[nucleobase modifying enzyme]-bNLS-[dCas9 or nCas9]-COOH
- $NH_2$-bNLS-[UGI]-[nucleobase modifying enzyme]-bNLS-[dCas9 or nCas9]-bNLS-COOH
- $NH_2$-[UGI]-bNLS-[nucleobase modifying enzyme]-bNLS-[dCas9 or nCas9]-bNLS-COOH
- $NH_2$-bNLS-[UGI]-bNLS-[nucleobase modifying enzyme]-bNLS-[dCas9 or nCas9]-bNLS-COOH
- $NH_2$-bNLS-[nucleobase modifying enzyme]-[UGI]-[dCas9 or nCas9]-COOH
- $NH_2$-[nucleobase modifying enzyme]-bNLS-[UGI]-[dCas9 or nCas9]-COOH
- $NH_2$-[nucleobase modifying enzyme]-[UGI]-bNLS-[dCas9 or nCas9]-bNLS-COOH
- $NH_2$-bNLS-[nucleobase modifying enzyme]-bNLS-[UGI]-[dCas9 or nCas9]-COOH
- $NH_2$-bNLS-[nucleobase modifying enzyme]-[UGI]-bNLS-[dCas9 or nCas9]-COOH
- $NH_2$-bNLS-[nucleobase modifying enzyme]-[UGI]-[dCas9 or nCas9]-bNLS-COOH $NH_2$-[nucleobase modifying enzyme]-bNLS-[UGI]-bNLS-[dCas9 or nCas9]-COOH
$NH_2$-[nucleobase modifying enzyme]-bNLS-[UGI]-[dCas9 or nCas9]-bNLS-COOH
$NH_2$-[nucleobase modifying enzyme]-[UGI]-bNLS-[dCas9 or nCas9]-bNLS-COOH
$NH_2$-bNLS-[nucleobase modifying enzyme]-bNLS-[UGI]-bNLS-[dCas9 or nCas9]-COOH
$NH_2$-bNLS-[nucleobase modifying enzyme]-bNLS-[UGI]-[dCas9 or nCas9]-bNLS-COOH
$NH_2$-[nucleobase modifying enzyme]-bNLS-[UGI]-bNLS-[dCas9 or nCas9]-bNLS-COOH
$NH_2$-bNLS-[nucleobase modifying enzyme]-bNLS-[UGI]-bNLS-[dCas9 or nCas9]-bNLS-COOH
$NH_2$-bNLS-[nucleobase modifying enzyme]-[dCas9 or nCas9]-[UGI]-COOH
$NH_2$-[nucleobase modifying enzyme]-bNLS-[dCas9 or nCas9]-[UGI]-COOH
$NH_2$-[nucleobase modifying enzyme]-[dCas9 or nCas9]-bNLS-[UGI]-COOH
$NH_2$-[nucleobase modifying enzyme]-[dCas9 or nCas9]-[UGI]-bNLS-COOH
$NH_2$-bNLS-[nucleobase modifying enzyme]-bNLS-[dCas9 or nCas9]-[UGI]-COOH
$NH_2$-bNLS-[nucleobase modifying enzyme]-[dCas9 or nCas9]-bNLS-[UGI]-COOH
$NH_2$-bNLS-[nucleobase modifying enzyme]-[dCas9 or nCas9]-[UGI]-bNLS-COOH
$NH_2$-bNLS-[nucleobase modifying enzyme]-bNLS-[dCas9 or nCas9]-bNLS-[UGI]-COOH
$NH_2$-bNLS-[nucleobase modifying enzyme]-bNLS-[dCas9 or nCas9]-[UGI]-bNLS-COOH
$NH_2$-bNLS-[nucleobase modifying enzyme]-[dCas9 or nCas9]-bNLS-[UGI]-bNLS-COOH
$NH_2$-[nucleobase modifying enzyme]-bNLS-[dCas9 or nCas9]-bNLS-[UGI]-bNLS-COOH
$NH_2$-bNLS-[nucleobase modifying enzyme]-bNLS-[dCas9 or nCas9]-bNLS-[UGI]-bNLS-COOH
$NH_2$-bNLS-[dCas9 or nCas9]-[nucleobase modifying enzyme]-COOH
$NH_2$-[dCas9 or nCas9]-bNLS-[nucleobase modifying enzyme]-COOH
$NH_2$-[dCas9 or nCas9]-[nucleobase modifying enzyme]-bNLS-COOH
$NH_2$-bNLS-[dCas9 or nCas9]-bNLS-[nucleobase modifying enzyme]-COOH
$NH_2$-bNLS-[dCas9 or nCas9]-[nucleobase modifying enzyme]-bNLS-COOH
$NH_2$-[dCas9 or nCas9]-bNLS-[nucleobase modifying enzyme]-bNLS-COOH
$NH_2$-bNLS-[dCas9 or nCas9]-bNLS-[nucleobase modifying enzyme]-bNLS-COOH
$NH_2$-bNLS-[UGI][dCas9 or nCas9]-[nucleobase modifying enzyme]-COOH
$NH_2$-[UGI]-bNLS-[dCas9 or nCas9]-[nucleobase modifying enzyme]-COOH
$NH_2$-[UGI][dCas9 or nCas9]-bNLS-[nucleobase modifying enzyme]-COOH
$NH_2$-[UGI][dCas9 or nCas9]-[nucleobase modifying enzyme]-bNLS-COOH
$NH_2$-bNLS-[UGI]-bNLS-[dCas9 or nCas9]-[nucleobase modifying enzyme]-COOH
$NH_2$-bNLS-[UGI][dCas9 or nCas9]-bNLS-[nucleobase modifying enzyme]-COOH
$NH_2$-bNLS-[UGI][dCas9 or nCas9]-[nucleobase modifying enzyme]-bNLS-COOH
$NH_2$-[UGI]-bNLS-[dCas9 or nCas9]-bNLS-[nucleobase modifying enzyme]-COOH
$NH_2$-[UGI]-bNLS-[dCas9 or nCas9]-[nucleobase modifying enzyme]-bNLS-COOH
$NH_2$-[UGI][dCas9 or nCas9]-bNLS-[nucleobase modifying enzyme]-bNLS-COOH
$NH_2$-bNLS-[UGI]-bNLS-[dCas9 or nCas9]-bNLS-[nucleobase modifying enzyme]-COOH
$NH_2$-bNLS-[UGI][dCas9 or nCas9]-bNLS-[nucleobase modifying enzyme]-bNLS-COOH
$NH_2$-bNLS-[UGI]-bNLS-[dCas9 or nCas9]-[nucleobase modifying enzyme]-bNLS-COOH
$NH_2$-[UGI]-bNLS-[dCas9 or nCas9]-bNLS-[nucleobase modifying enzyme]-bNLS-COOH
$NH_2$-bNLS-[UGI]-bNLS-[dCas9 or nCas9]-bNLS-[nucleobase modifying enzyme]-bNLS-COOH
$NH_2$-bNLS-[dCas9 or nCas9]-[UGI]-[nucleobase modifying enzyme]-COOH
$NH_2$-[dCas9 or nCas9]-bNLS-[UGI]-[nucleobase modifying enzyme]-COOH
$NH_2$-[dCas9 or nCas9]-[UGI]-bNLS-[nucleobase modifying enzyme]-COOH
$NH_2$-[dCas9 or nCas9]-[UGI]-[nucleobase modifying enzyme]-bNLS-COOH
$NH_2$-bNLS-[dCas9 or nCas9]-bNLS[UGI]-[nucleobase modifying enzyme]-COOH
$NH_2$-bNLS-[dCas9 or nCas9]-[UGI]-bNLS-[nucleobase modifying enzyme]-COOH
$NH_2$-bNLS-[dCas9 or nCas9]-[UGI]-[nucleobase modifying enzyme]-bNLS-COOH
$NH_2$-[dCas9 or nCas9]-bNLS-[UGI]-bNLS-[nucleobase modifying enzyme]-COOH
$NH_2$-[dCas9 or nCas9]-bNLS-[UGI]-[nucleobase modifying enzyme]-bNLS-COOH
$NH_2$-[dCas9 or nCas9]-[UGI]-bNLS-[nucleobase modifying enzyme]-bNLS-COOH
$NH_2$-bNLS-[dCas9 or nCas9]-bNLS-[UGI]-bNLS-[nucleobase modifying enzyme]-COOH
$NH_2$-bNLS-[dCas9 or nCas9]-bNLS-[UGI]-[nucleobase modifying enzyme]-bNLS-COOH
$NH_2$-bNLS-[dCas9 or nCas9]-[UGI]-bNLS-[nucleobase modifying enzyme]-bNLS-COOH
$NH_2$-[dCas9 or nCas9]-bNLS-[UGI]-bNLS-[nucleobase modifying enzyme]-bNLS-COOH
$NH_2$-bNLS-[dCas9 or nCas9]-bNLS-[UGI]-bNLS-[nucleobase modifying enzyme]-bNLS-COOH
$NH_2$-bNLS-[dCas9 or nCas9]-[nucleobase modifying enzyme]-[UGI]-COOH
$NH_2$-[dCas9 or nCas9]-bNLS-[nucleobase modifying enzyme]-[UGI]-COOH
$NH_2$-[dCas9 or nCas9]-[nucleobase modifying enzyme]-bNLS-[UGI]-COOH
$NH_2$-[dCas9 or nCas9]-[nucleobase modifying enzyme]-[UGI]-bNLS-COOH
$NH_2$-bNLS-[dCas9 or nCas9]-bNLS-[nucleobase modifying enzyme]-[UGI]-COOH
$NH_2$-bNLS-[dCas9 or nCas9]-[nucleobase modifying enzyme]-bNLS-[UGI]-COOH
$NH_2$-bNLS-[dCas9 or nCas9]-[nucleobase modifying enzyme]-[UGI]-bNLS-COOH
$NH_2$-[dCas9 or nCas9]-bNLS-[nucleobase modifying enzyme]-bNLS-[UGI]-COOH
$NH_2$-[dCas9 or nCas9]-bNLS-[nucleobase modifying enzyme]-[UGI]-bNLS-COOH
$NH_2$-[dCas9 or nCas9]-[nucleobase modifying enzyme]-bNLS-[UGI]-bNLS-COOH $NH_2$-bNLS-[dCas9 or nCas9]-bNLS-[nucleobase modifying enzyme]-bNLS-[UGI]-COOH $NH_2$-bNLS-[dCas9 or nCas9]-bNLS-[nucleobase modifying enzyme]-[UGI]-bNLS-COOH $NH_2$-bNLS-[dCas9 or nCas9]-[nucleobase modifying enzyme]-bNLS-[UGI]-bNLS-COOH $NH_2$-[dCas9 or nCas9]-bNLS-[nucleobase modifying enzyme]-bNLS-[UGI]-bNLS-COOH or $NH_2$-bNLS-[dCas9 or nCas9]-bNLS-[nucleobase modifying enzyme]-bNLS-[UGI]-bNLS-COOH Herein, "$NH_2$—" represents the N-terminus of a protein or polypeptide, and "—COOH" represents the C-terminus of a protein or polypeptide. "]-[" represents a peptide bond or a linker. In some embodiments, linkers may be used to link any of the protein or protein domains described herein. The linker may be as simple as a covalent bond, or it may be a polymeric linker many atoms in length. In some embodiments, the linker is a polypeptide or based on amino acids. In some embodiments, the linker is not peptide-like. In some embodiments, the linker is a covalent bond (e.g., a carbon-carbon bond, disulfide bond, carbon-heteroatom bond, etc.). In some embodiments, the linker is a carbon-nitrogen bond of an amide linkage. In some embodiments, the linker is a cyclic or acyclic, substituted or unsubstituted, branched or unbranched aliphatic or heteroaliphatic linker. In some embodiments, the linker is polymeric (e.g., polyethylene, polyethylene glycol, polyamide, polyester, etc.). In some embodiments, the linker comprises a monomer, dimer, or polymer of aminoalkanoic acid. In some embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, the linker comprises a monomer, dimer, or polymer of aminohexanoic acid (Ahx). In some embodiments, the linker is based on a carbocyclic moiety (e.g., cyclopentane, cyclohexane). In some embodiments, the linker comprises a polyethylene glycol moiety (PEG). In some embodiments, the linker comprises amino acids. In some embodiments, the linker comprises a peptide. In some embodiments, the linker comprises an aryl or heteroaryl moiety. In some embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 377), which may also be referred to as the XTEN linker. In some embodiments, a linker comprises the amino acid sequence: SGGS (SEQ ID NO: 378). In some embodiments, a linker comprises the amino acid sequence: $(SGGS)_n$ (SEQ ID NO: 557), $(GGGS)_n$ (SEQ ID NO: 558), $(GGGGS)_n$ (SEQ ID NO: 559), $(G)_n$ (SEQ ID NO: 390), (EAAAK). (SEQ ID NO: 560), $(GGS)_n$ (SEQ ID NO: 562), SGSETPGTSESATPES (SEQ ID NO: 377), or $(XP)_n$ (SEQ ID NO: 563) motif, or a combination of any of these, wherein n is independently an integer between 1 and 30, inclusive, and wherein X is any amino acid. In some embodiments, n is 1, 2, 3, 4, 5, 6, 7, 8, 9, 10, 11, 12, 13, 14, or 15. In some embodiments, the linker comprises the amino acid sequence: SGSETPGTSESATPES (SEQ ID NO: 377), and SGGS (SEQ ID NO: 378). In some embodiments, the linker comprises the amino acid sequence: SGGSSGSETPGTSESATPESSGGS (SEQ ID NO: 561). In some embodiments, a linker comprises the amino acid sequence: SGGSSGGSSGSETPGTSESATPESSGGSSGGS (SEQ ID NO: 384). In some embodiments, a linker comprises the amino acid sequence: GGSGGSPGSPAGSPTSTEEGTSESATPESGPGTSTEPSEGSAPGSPAGSPTSTEEGTSTEPSE GSAPGTSTEPSEGSAPGTSESATPESGPGSEPATSGGSGGS (SEQ ID NO: 564).

In some embodiments, the linker is 24 amino acids in length. In some embodiments, the linker comprises the amino acid sequence SGGSSGGSSGSETPGTSESATPES (SEQ ID NO: 343). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 391). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGSSGG S (SEQ ID NO: 392). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAPGTS TEPSEGSAPGTSESATPESGPGSEPATS (SEQ ID NO: 393).

In some embodiments, the first and second nucleotide sequences are on the same nucleic acid vector. In some embodiments, the first and second nucleotide sequences are on different nucleic acid vectors. In some embodiments, the vector is a plasmid. In some embodiments, the nucleic acid vector is a recombinant genome of a adeno-associated virus (rAAV). In some embodiments, the nucleic acid vector is the genome of an adeno-associated virus packaged in a rAAV particle. In some embodiments, the first and/or the second nucleotide sequence is operably linked to a promoter. In some embodiments, the nucleic acid vector further comprise a nucleotide sequence encoding one or more (e.g., 1, 2, 3, 4, 5, 6, 7, 8, 9, 10, or more) gRNAs operably linked to a promoter. In some embodiments, the promoter is a constitutive promoter. In some embodiments, the promoter is an inducible promoter.

An inducible promoter of the present disclosure may be induced by (or repressed by) one or more physiological condition(s), such as changes in light, pH, temperature, radiation, osmotic pressure, saline gradients, cell surface binding, and the concentration of one or more extrinsic or intrinsic inducing agent(s). An extrinsic inducer signal or inducing agent may comprise, without limitation, amino acids and amino acid analogs, saccharides and polysaccharides, nucleic acids, protein transcriptional activators and repressors, cytokines, toxins, petroleum-based compounds, metal containing compounds, salts, ions, enzyme substrate analogs, hormones, or combinations thereof.

Inducible promoters of the present disclosure include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells). Other inducible promoter systems are known in the art and may be used in accordance with the present disclosure.

In some embodiments, inducible promoters of the present disclosure function in prokaryotic cells (e.g., bacterial cells). Examples of inducible promoters for use prokaryotic cells include, without limitation, bacteriophage promoters (e.g. Pls icon, T3, T7, SP6, PL) and bacterial promoters (e.g., Pbad, PmgrB, Ptrc2, Plac/ara, Ptac, Pm), or hybrids thereof (e.g. PLlacO, PLtetO). Examples of bacterial promoters for use in accordance with the present disclosure include, without limitation, positively regulated *E. coli* promoters, such as positively regulated 670 promoters (e.g., inducible pBad/araC promoter, Lux cassette right promoter, modified lamdba Prm promote, plac Or2-62 (positive), pBad/AraC with extra REN sites, pBad, P(Las) TetO, P(Las) CIO, P(Rhl), Pu, FecA, pRE, cadC, hns, pLas, pLux), GS promoters (e.g., Pdps), 632 promoters (e.g., heat shock), and 654 promoters (e.g., glnAp2); negatively regulated *E. coli* promoters such as negatively regulated 670 promoters (e.g., Promoter (PRM+), modified lamdba Prm promoter, TetR-TetR-4C P(Las) TetO, P(Las) CIO, P(Lac) IQ, RecA_DlexO_DLacO1, dapAp, FecA, Pspac-hy, pcI, plux-cI, plux-lac, CinR, CinL, glucose controlled, modified Pr, modified Prm+, FecA, Pcya, rec A (SOS), Rec A (SOS), EmrR_regulated, BetI_regulated, pLac_lux, pTet_Lac, pLac/Mnt, pTet/Mnt, LsrA/cI, pLux/cI, LacI, LacIQ, pLacIQ1, pLas/cI, pLas/Lux, pLux/Las, pRecA with LexA binding site, reverse BBa_R0011, pLacI/ara-1, pLacIq, rrnB P1, cadC, hns, PfhuA, pBad/araC, nhaA, OmpF, RcnR), σS promoters (e.g., Lutz-Bujard LacO with alternative sigma factor σ38), σ32 promoters (e.g., Lutz-Bujard LacO with alternative sigma factor σ32), and σ54 promoters (e.g., glnAp2); negatively regulated *B. subtilis* promoters such as repressible *B. subtilis* σA promoters (e.g., Gram-positive IPTG-inducible, Xyl, hyper-spank) and σB promoters. Other inducible microbial promoters may be used in accordance with the present disclosure.

In some embodiments, inducible promoters of the present disclosure function in eukaryotic cells (e.g., mammalian cells). Examples of inducible promoters for use eukaryotic cells include, without limitation, chemically-regulated promoters (e.g., alcohol-regulated promoters, tetracycline-regulated promoters, steroid-regulated promoters, metal-regulated promoters, and pathogenesis-related (PR) promoters) and physically-regulated promoters (e.g., temperature-regulated promoters and light-regulated promoters).

Guide RNAs

The present disclosure further provides guide RNAs for use in accordance with the disclosed base editors and methods of editing. The disclosure provides guide RNAs that are designed to recognize target sequences. Such gRNAs may be designed to have guide sequences (or "spacers") having complementarity to a protospacer within the target sequence. Guide RNAs are also provided for use with one or more of the disclosed fusion proteins, e.g., in the disclosed methods of editing a nucleic acid molecule. Such gRNAs may be designed to have guide sequences having complementarity to a protospacer within a target sequence to be edited, and to have backbone sequences that interact specifically with the napDNAbp domains of any of the disclosed nucleobase editors, such as Cas9 nickase domains of the disclosed nucleobase editors.

The disclosure further provides methods for editing a target nucleic acid molecule, e.g., a single nucleobase within a genome, with a nucleobase editor described herein, e.g., a split nucleobase editor. Such methods involve transducing (e.g., via transfection) cells with a plurality of complexes each comprising a fusion protein (e.g., a fusion protein comprising a Cas9 nickase (nCas9) domain and an adenosine deaminase domain) and a gRNA molecule. In some embodiments, the gRNA is bound to the napDNAbp domain (e.g., nCas9 domain) of the fusion protein. In some embodiments, each gRNA comprises a guide sequence of at least 10 contiguous nucleotides (e.g., 10, 11, 12, 13, 14, 15, 16, 17, 18, 19, 20, 21, 22, 23, 24, 25, 26, 27, 28, 29, or 30 contiguous nucleotides) that is complementary to a target sequence. In certain embodiments, the methods involve the transfection of nucleic acid constructs (e.g., plasmids) that each (or together) encode the components of a complex of fusion protein and gRNA molecule.

Some aspects of the invention relate to guide sequences ("guide RNA" or "gRNA") that are capable of guiding a napDNAbp or a nucleobase editor comprising a napDNAbp to a target site, e.g. a target site in the NPC1 gene or TMC1 gene. Exemplary guide sequences suitable for targeting the NPC1 and Tmc1 genes and used in the experiments of Examples 1-4 are provided in Table 6 (SEQ ID NOs: 669-743). The guide RNA may be 15-100 nucleotides in length and comprise a sequence of at least 10, at least 15, or at least 20 contiguous nucleotides that is complementary to a target nucleotide sequence. The guide RNA may comprise a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target nucleotide sequence.

In other aspects, the present specification provides complexes comprising the nucleobase editors described herein and a gRNA bound to the Cas9 domain of the fusion protein, such as a single guide RNA. In various embodiments, nucleobase editors (e.g., the split nucleobase editors provided herein) can be complexed, bound, or otherwise associated with (e.g., via any type of covalent or non-covalent bond) one or more guide sequences, i.e., the sequence which becomes associated or bound to the nucleobase editor and directs its localization to a specific target sequence having complementarity to the guide sequence or a portion thereof. The particular design aspects of a guide sequence will depend upon the nucleotide sequence of a genomic target site of interest (e.g., in human NPC) and the type of napDNA/RNAbp (e.g., type of Cas protein) present in the nucleobase editor, among other factors, such as PAM sequence locations, percent G/C content in the target sequence, the degree of microhomology regions, secondary structures, etc. Accordingly, in some embodiments, the disclosure provides compositions comprising complexes any of the disclosed nucleobase editors and a guide RNA comprising a guide sequence comprising a nucleotide sequence of any of SEQ ID NOs: 669-743. In some embodiments of the disclosed complexes, the guide RNA comprises a sequence that differs from any of SEQ ID NOs: 669-743 by no more than 1, 2, 3, or 4 nucleotides.

In some embodiments, the disclosure provides compositions comprising i) vectors encoding any of the disclosed nucleobase editors and ii) a guide RNA comprising a guide sequence comprising a nucleotide sequence of any of SEQ ID NOs: 669-743. In some embodiments, these vectors comprise i) a nucleic acid encoding an N-terminal portion of a split nucleobase editor, ii) a nucleic acid encoding a C-terminal portion of a split nucleobase editor, and iii) a guide RNA comprising a guide sequence comprising a nucleotide sequence of any of SEQ ID NOs: 669-743. In some embodiments of the disclosed vectors, the guide RNA comprises a sequence that differs from any of SEQ ID NOs: 669-743 by no more than 1, 2, 3, or 4 nucleotides.

The present disclosure also provides compositions of guide RNAs. In particular embodiments, the disclosure provides compositions of guide RNAs comprising a guide sequence comprising a nucleotide sequence of any of SEQ ID NOs: 669-743. The present disclosure also provides methods of editing target DNA sequences in an NPC1 gene or a TMC1 gene using compositions and/or complexes comprising any of the disclosed guide RNAs.

In some embodiments, a guide sequence is less than about 35, 30, 25, 20, 15, 12, or fewer nucleotides in length. The ability of a guide sequence to direct sequence-specific binding of a nucleobase editor to a target sequence may be assessed by any suitable assay. For example, the components of a nucleobase editor, including the guide sequence to be tested, may be provided to a host cell having the corresponding target sequence (e.g., a HGADFN 167 or HGADFN 188 cell line), such as by transfection with vectors encoding the components of a nucleobase editor disclosed herein, followed by an assessment of preferential cleavage within the target sequence. Similarly, cleavage of a target polynucleotide sequence may be evaluated in a test tube by providing the target sequence, components of a nucleobase editor, including the guide sequence to be tested and a control guide sequence different from the test guide sequence, and comparing binding or rate of cleavage at the target sequence between the test and control guide sequence reactions. Other assays are possible, and will occur to those skilled in the art.

In addition to the SDS, the gRNA comprises a scaffold sequence (corresponding to the tracrRNA in the native CRISPR/Cas system) that is required for its association with Cas9 (sometimes referred to herein as the "gRNA handle," "gRNA core" or "gRNA backbone"). In various embodiments, the guide RNA scaffold binds an *S. pyogenes* Cas9. In other embodiments, the guide RNA scaffold binds an *S. aureus* Cas9. In some embodiments, the guide RNAs for use in accordance with the disclosed methods of editing comprise a backbone structure that is recognized by an *S. pyogenes* Cas9 protein or domain, such as an SpCas9 domain of the disclosed nucleobase editors. The backbone structure recognized by an SpCas9 protein may comprise the sequence 5'-[guide sequence]-guuuuagagcuagaaauagcaaguuaaaauaaggcuaguccguuaucaacuugaaaaaguggcaccgagucggugcuuuuu-3' (SEQ ID NO: 443), wherein the guide sequence comprises a sequence that is complementary to the protospacer of the target sequence. See U.S. Publication No. 2015/0166981, published Jun. 18, 2015, the disclosure of which is incorporated by reference herein. In other embodiments, the guide RNAs for use in accordance with the disclosed methods of editing comprise a backbone structure that is recognized by an *S. aureus* Cas9 protein. The backbone structure recognized by an SaCas9 protein may comprise the sequence 5'-[guide sequence]-guuuuaguacucuguaaugaaaauuacagaaucuacuaaaacaaggcaaaaugccguguuuaucucgucaacuuguuggcgag auuuuuuu-3' (SEQ ID NO: 565).

In other embodiments, the guide RNAs for use in accordance with the disclosed methods of editing comprise a backbone structure that is recognized by an Lachnospiraceae bacterium Cas12a protein. The backbone structure recognized by an LbCas12a protein may comprise the sequence 5'-[guide sequence]-uaauuucuacuaaguguagau-3' (SEQ ID NO: 566). In other embodiments, the guide RNAs for use in accordance with the disclosed methods of editing comprise a backbone structure that is recognized by an Acidaminococcus sp. BV3L6 Cas12a protein. The backbone structure recognized by an AsCas12a protein may comprise the sequence 5'-[guide sequence]-uaauuucuacucuuguagau-3' (SEQ ID NO: 567).

Other non-limiting, suitable gRNA scaffold sequences that may be used in accordance with the present disclosure are listed in Table 2. In other embodiments, the guide RNAs for use in accordance with the disclosed methods of editing comprise a backbone structure that comprises any of SEQ ID NOs: 359-361, 363, 366, 368, and 569-575.

TABLE 2

Guide RNA Handle Sequences

| Organism | gRNA scaffold sequence | SEQ ID NO |
|---|---|---|
| *S. pyogenes* | GUUUAAGAGCUAUGCUGGAAAGCCACGGUGAA AAAGUUCAACUAUUGCCUGAUCGGAAUAAAUU UGAACGAUACGACAGUCGGUGCUUUUUUU | 359 |
| *S. pyogenes* | GUUUAAGAGCUAGAAAUAGCAAGUUUAAAUAA GGCUAGUCCGUUAUCAACUUGAAAAAGUGGCA CCGAGUCGGUGCUUUUUU | 360 |
| *S. thermophilus* CRISPR1 | GUUUUUGUACUCUCAAGAUUCAAUAAUCUUGC AGAAGCUACAAAGAUAAGGCUUCAUGCCGAAA UCAACACCCUGUCAUUUUAUGGCAGGGUGUUU U | 361 |
| *S. thermophilus* CRISPR3 | GUUUUAGAGCUGUGUUGUUUGUUAAAACAACA CAGCGAGUUAAAAUAAGGCUUAGUCCGUACUC AACUUGAAAAGGUGGCACCGAUUCGGUGUUUU U | 568 |

TABLE 2-continued

| Guide RNA Handle Sequences | | |
|---|---|---|
| Organism | gRNA scaffold sequence | SEQ ID NO |
| *C. jejuni* | AAGAAAUUUAAAAAGGGACUAAAAUAAAGAGU UUGCGGGACUCUGCGGGGUUACAAUCCCCUAAA ACCGCUUUU | 363 |
| *F. novicida* | AUCUAAAAUUAUAAAUGUACCAAAUAAUUAAU GCUCUGUAAUCAUUUAAAAGUAUUUUGAACGG ACCUCUGUUUGACACGUCUGAAUAACUAAAA | 569 |
| *S. thermophilus*2 | UGUAAGGGACGCCUUACACAGUUACUUAAAUC UUGCAGAAGCUACAAAGAUAAGGCUUCAUGCC GAAAUCAACACCCUGUCAUUUUAUGGCAGGGU GUUUUCGUUAUUU | 570 |
| *M. mobile* | UGUAUUUCGAAAUACAGAUGUACAGUUAAGAA UACAUAAGAAUGAUACAUCACUAAAAAAAGGC UUUAUGCCGUAACUACUACUUAUUUUCAAAAU AAGUAGUUUUUUUU | 366 |
| *L. innocua* | AUUGUUAGUAUUCAAAAUAACAUAGCAAGUUA AAAUAAGGCUUUGUCCGUUAUCAACUUUUAAU UAAGUAGCGCUGUUUCGGCGCUUUUUUU | 571 |
| *S. pyogenes* | GUUGGAACCAUUCAAAACAGCAUAGCAAGUUA AAAUAAGGCUAGUCCGUUAUCAACUUGAAAAA GUGGCACCGAGUCGGUGCUUUUUUU | 368 |
| *S. mutans* | GUUGGAAUCAUUCGAAACAACACAGCAAGUUA AAAUAAGGCAGUGAUUUUUAAUCCAGUCCGUA CACAACUUGAAAAAGUGCGCACCGAUUCGGUGC UUUUUUAUUU | 572 |
| *S. thermophilus* | UUGUGGUUUGAAACCAUUCGAAACAACACAGC GAGUUAAAAUAAGGCUUAGUCCGUACUCAACU UGAAAAGGUGGCACCGAUUCGGUGUUUUUUUU | 573 |
| *N. meningitidis* | ACAUAUUGUCGCACUGCGAAAUGAGAACCGUU GCUACAAUAAGGCCGUCUGAAAAGAUGUGCCG CAACGCUCUGCCCCUUAAAGCUUCUGCUUUAAG GGGCA | 574 |
| *P. multocida* | GCAUAUUGUUGCACUGCGAAAUGAGAGACGUU GCUACAAUAAGGCUUCUGAAAAGAAUGACCGU AACGCUCUGCCCCUUGUGAUUCUUAAUUGCAAG GGGCAUCGUUUUU | 575 |

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see, e.g., A. R. Gruber et al., 2008, *Cell* 106(1): 23-24; and P A Carr & G M Church, 2009, *Nature Biotechnology* 27(12): 1151-62). Additional algorithms may be found in Chuai, G. et al., *DeepCRISPR: optimized CRISPR guide RNA design by deep learning, Genome Biol.* 19:80 (2018), and PCT Application No. PCT/US2018/065886 and U.S. Pat. No. 8,871,445, issued Oct. 28, 2014, the entireties of each of which are incorporated herein by reference.

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a complex at a target sequence, wherein the complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. Preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In some embodiments, the single transcript further includes a transcription termination sequence; preferably this is a polyT sequence, for example six T nucleotides. Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator: (1) NNNNNNNNgtttttgtactctcaagatttaGAAAtaaatcttgcagaagctacaaagataaggctt catgccgaaatcaacaccctgtcattttatggcagggtgttttcgttatttaaTTTTTT (SEQ ID NO: 201); (2) NNNNNNNNNNNNNNNNNN gtttttgtactctcaGAAAtgcagaagctacaaagataaggcttcatgccgaaatca acaccctgtcattttatggcagggtgttttcgttatttaaTTTTTT (SEQ ID NO: 202); (3) NNNNNNNNNNNNNNNNNNNNgtttttgtactctcaGAAA tgcagaagctacaaagataaggcttcatgccgaaatca acaccctgtcattttatggcagggtgtTTTTT (SEQ ID NO: 203); (4) NNNNNNNNNNNNNNNNNNNNgttttagagctaGAAAtagcaagttaaaataaggctagtccgttatcaacttgaaaa agtggcaccgagtcggtgcTTTTTT (SEQ ID NO: 204); (5) NNNNNNNNNNNNNNNNNNNNgttttagagctaGAAATAGcaagttaaaataaggctagtccgttatcaacttgaa aaagtgTTTTTTT (SEQ ID NO: 205); and (6) NNNNNNNNNNNNNNNNNNNNgttttagagctagAAATAGcaagttaaaataaggctagtccgttatcaTTTTTT TT (SEQ ID NO: 206). In some embodiments, sequences (1) to (3) are used in combination with Cas9 from *S. thermophilus* CRISPR. In some embodiments, sequences (4) to (6) are used in combination with Cas9 from *S. pyogenes*. In some embodiments, the tracr sequence is a separate transcript from a transcript comprising the tracr mate sequence.

It will be apparent to those of skill in the art that in order to target any of the fusion proteins comprising a Cas9 domain and a deaminase, as disclosed herein, to a target site to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein.

Recombinant Adeno-Associated Viral (rAAV) Vectors

Some aspects of the present disclosure relate to using recombinant adeno-associated virus vectors for the delivery of a split Cas9 protein or a split nucleobase editor into a cell. The N-terminal portion of the Cas9 protein or the nucleobase editor and the C-terminal portion of the Cas9 protein or the nucleobase editor are delivered by separate rAAV vectors or particles into the same cell, since the full-length Cas9 protein or nucleobase editors exceeds the packaging limit of rAAV (~4.9 kb).

As such, in some embodiments, a composition for delivering the split Cas9 protein or split nucleobase editor into a cell (e.g., a mammalian cell, a human cell) is provided. In some embodiments, the composition of the present disclosure comprises: (i) a first recombinant adeno-associated virus (rAAV) particle comprising a first nucleotide sequence encoding a N-terminal portion of a Cas9 protein or nucleobase editor fused at its C-terminus to an intein-N; and (ii) a second recombinant adeno-associated virus (rAAV) particle comprising a second nucleotide sequence encoding an intein-C fused to the N-terminus of a C-terminal portion of the Cas9 protein or nucleobase editor. The rAAV particles of the present disclosure comprise a rAAV vector (i.e., a recombinant genome of the rAAV) encapsidated in the viral capsid proteins.

In some embodiments, any of the disclosed rAAV vectors encoding the N-terminal portions or the C-terminal portions of the split nucleobase editors may comprise a nucleotide sequence that is at least 70%, at least 75%, at least 80%, at least 85%, at least 90%, at least 95%, at least 96%, at least 97%, at least 98%, at least 99%, or at least 99.5% identical to any one of the sequences depicted in FIGS. 26A-26U (SEQ ID NOs: 642-653). In particular embodiments, the disclosed rAAV vectors comprise a nucleotide sequence that is at least 90% identical to any one of the sequences set forth as SEQ ID NOs: 642-653. In some embodiments, the disclosed rAAV vectors comprise a nucleotide sequence that comprises any one of the sequences of SEQ ID NOs: 642-653.

In some embodiments, any of the disclosed nucleic acid molecules encoding an N-terminal portion of a nucleobase editor fused at its C-terminus to an intein-N may comprise a nucleotide sequence that is at least 70%, at least 75%, at least 80%, at least 85%, at least 90%, at least 95%, at least 96%, at least 97%, at least 98%, at least 99%, or at least 99.5% identical to any one of the nucleotide sequences of SEQ ID NOs: 642, 644, 646, 648, 650, and 652. In some embodiments, any of the disclosed nucleic acid molecules encoding an N-terminal portion of a nucleobase editor may comprise a nucleotide sequence that differs by about 10, 15, 20, 25, 30, 35, 40, 45, 50, or more than 50 nucleotides from any one of the sequences of SEQ ID NOs: 642, 644, 646, 648, 650, and 652. In particular embodiments, any of the disclosed nucleic acid molecules encoding an N-terminal portion of a nucleobase editor fused at its C-terminus to an intein-N may comprise a nucleotide sequence that comprises any one of the sequences of SEQ ID NOs: 642, 644, 646, 648, 650, and 652.

In some embodiments, any of the disclosed nucleic acid molecules encoding a C-terminal portion of a nucleobase editor fused at its N-terminus to an intein-C may comprise a nucleotide sequence that is at least 70%, at least 75%, at least 80%, at least 85%, at least 90%, at least 95%, at least 96%, at least 97%, at least 98%, at least 99%, or at least 99.5% identical to any one of the nucleotide sequences of SEQ ID NOs: 643, 645, 647, 649, 651, and 653. In some embodiments, any of the disclosed nucleic acid molecules encoding a C-terminal portion of a nucleobase editor may comprise a nucleotide sequence that differs by about 10, 15, 20, 25, 30, 35, 40, 45, 50, or more than 50 nucleotides from any one of the sequences of SEQ ID NOs: 643, 645, 647, 649, 651, and 653. In particular embodiments, any of the disclosed nucleic acid molecules encoding an N-terminal portion of a nucleobase editor fused at its C-terminus to an intein-N may comprise a nucleotide sequence that comprises any one of the sequences of SEQ ID NOs: 643, 645, 647, 649, 651, and 653.

In some embodiments, the disclosure provides compositions comprising a first nucleic acid molecule encoding a C-terminal portion of a nucleobase editor fused at its N-terminus to an intein-C that comprises a nucleotide sequence that is at least 80%, at least 85%, at least 90%, at least 95%, at least 96%, at least 97%, at least 98%, at least 99%, or at least 99.5% identical to any one of the nucleotide sequences of SEQ ID NOs: 642, 644, 646, 648, 650, and 652; and a second nucleic acid molecule encoding a C-terminal portion of a nucleobase editor fused at its N-terminus to an intein-C that comprises a nucleotide sequence that is at least 80%, at least 85%, at least 90%, at least 95%, at least 96%, at least 97%, at least 98%, at least 99%, or at least 99.5% identical to any one of the nucleotide sequences of SEQ ID NOs: 643, 645, 647, 649, 651, and 653. In particular embodiments, the compositions comprise a first nucleic acid molecule that comprises any one of the nucleotide sequences of SEQ ID NOs: 642, 644, 646, 648, 650, and 652, and a second nucleic acid molecule that comprises any one of the nucleotide sequences of SEQ ID NOs: 643, 645, 647, 649, 651, and 653. The disclosure also provides rAAV particles comprising any of the first nucleic acid molecules and second nucleic acid molecules described herein.

In some embodiments, the rAAV vector comprises: (1) a heterologous nucleic acid region comprising the first or second nucleotide sequence encoding the N-terminal portion or C-terminal portion of a split Cas9 protein or a split nucleobase editor in any form as described herein, (2) one or more nucleotide sequences comprising a sequence that facilitates expression of the heterologous nucleic acid region (e.g., a promoter), and (3) one or more nucleic acid regions comprising a sequence that facilitate integration of the heterologous nucleic acid region (optionally with the one or more nucleic acid regions comprising a sequence that facilitates expression) into the genome of a cell. In some embodiments, viral sequences that facilitate integration comprise Inverted Terminal Repeat (ITR) sequences. In some embodiments, the first or second nucleotide sequence encoding the N-terminal portion or C-terminal portion of a split Cas9 protein or a split nucleobase editor is flanked on each side by an ITR sequence. In some embodiments, the nucleic acid vector further comprises a region encoding an AAV Rep protein as described herein, either contained within the region flanked by ITRs or outside the region. The ITR sequences can be derived from any AAV serotype (e.g., 1, 2, 3, 4, 5, 6, 7, 8, 9, or 10) or can be derived from more than one serotype. In some embodiments, the ITR sequences are derived from AAV2, AAV8, AAV9, or AAV6.

Thus, in some embodiments, the rAAV particles disclosed herein comprise at least one rAAV2 particle, rAAV6 particle, rAAV8 particle, rPHP.B particle, rPHP.eB particle, or rAAV9 particle, or a variant thereof. In particular embodiments, the disclosed rAAV particles are rPHP.B particles, rPHP.eB particles, rAAV9 particles.

ITR sequences and plasmids containing ITR sequences are known in the art and commercially available (see, e.g., products and services available from Vector Biolabs, Philadelphia, PA; Cellbiolabs, San Diego, CA; Agilent Technologies, Santa Clara, Ca; and Addgene, Cambridge, MA; and Gene delivery to skeletal muscle results in sustained expression and systemic delivery of a therapeutic protein. Kessler P D, Podsakoff G M, Chen X, McQuiston S A, Colosi P C, Matelis L A, Kurtzman G J, Byrne B J. Proc Natl Acad Sci USA. 1996 Nov. 26; 93(24):14082-7; and Curtis A. Machida. Methods in Molecular Medicine™. Viral Vectors for Gene Therapy Methods and Protocols. 10.1385/1-59259-304-6:201 © Humana Press Inc. 2003. Chapter 10. Targeted Integration by Adeno-Associated Virus. Matthew D. Weitzman, Samuel M. Young Jr., Toni Cathomen and Richard Jude Samulski; U.S. Pat. Nos. 5,139,941 and 5,962,313, all of which are incorporated herein by reference). Exemplary ITR sequences are provided below.

```
AAV2:
                                          (SEQ ID NO: 576)
TTGGCCACTCCCTCTCTGCGCGCTCGCTCGCTCACTGAGGCCGGGCGAC
CAAAGGTCGCCCGACGCCCGGGCTTTGCCCGGGCGGCCTCAGTGAGCGA
GCGAGCGCGCAGAGAGGGAGTGGCCAACTCCATCACTAGGGGTTCCT

AAV3:
                                          (SEQ ID NO: 577)
TTGGCCACTCCCTCTATGCGCACTCGCTCGCTCGGTGGGGCCTGGCGAC
CAAAGGTCGCCAGACGGACGTGCTTTGCACGTCCGGCCCCACCGAGCGA
GCGAGTGCGCATAGAGGGAGTGGCCAACTCCATCACTAGAGGTATGGC

AAV5:
                                          (SEQ ID NO: 578)
CTCTCCCCCCTGTCGCGTTCGCTCGCTCGCTGGCTCGTTTGGGGGGGTG
GCAGCTCAAAGAGCTGCCAGACGACGGCCCTCTGGCCGTCGCCCCCCCA
AACGAGCCAGCGAGCGAGCGAACGCGACAGGGGGGAGAGTGCCACACTC
TCAAGCAAGGGGGTTTTGTA

AAV6:
                                          (SEQ ID NO: 389)
TTGCCCACTCCCTCTATGCGCGCTCGCTCGCTCGGTGGGGCCTGCGGAC
CAAAGGTCCGCAGACGGCAGAGCTCTGCTCTGCCGGCCCCACCGAGCGA
GCGAGCGCGCATAGAGGGAGTGGGCAACTCCATCACTAGGGGTA
```

In some embodiments, the rAAV vector of the present disclosure comprises one or more regulatory elements to control the expression of the heterologous nucleic acid region (e.g., promoters, transcriptional terminators, and/or other regulatory elements). In some embodiments, the first and/or second nucleotide sequence is operably linked to one or more (e.g., 1, 2, 3, 4, 5, or more) transcriptional terminators. Non-limiting examples of transcriptional terminators that may be used in accordance with the present disclosure include transcription terminators of the bovine growth hormone gene (bGH), human growth hormone gene (hGH), SV40, CW3, ϕ, or combinations thereof. The efficiencies of several transcriptional terminators have been tested to determine their respective effects in the expression level of the split Cas9 protein or the split nucleobase editor (e.g., see FIG. 4). In some embodiments, the transcriptional terminator used in the present disclosure is a bGH transcriptional terminator. In some embodiments, the rAAV vector further comprises a Woodchuck Hepatitis Virus Posttranscriptional Regulatory Element (WPRE). In certain embodiments, the WPRE is a truncated WPRE sequence, such as W3. In some embodiments, the WPRE is inserted 5' of the transcriptional terminator.

In some embodiments, the composition comprising the rAAV particle (in any form contemplated herein) further comprises a pharmaceutically acceptable carrier. In some embodiments, the composition is formulated in appropriate pharmaceutical vehicles for administration to human or animal subjects.

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

Methods of Treatment and Uses

Other aspects of the present disclosure provide methods of delivering the split Cas9 protein or the split nucleobase editor into a cell to form a complete and functional Cas9 protein or nucleobase editor. For example, in some embodiments, a cell is contacted with a composition described herein (e.g., compositions comprising nucleotide sequences encoding the split Cas9 or the split nucleobase editor or AAV particles containing nucleic acid vectors comprising such nucleotide sequences). In some embodiments, the contacting results in the delivery of such nucleotide sequences into a cell, wherein the N-terminal portion of the Cas9 protein or the nucleobase editor and the C-terminal portion of the Cas9 protein or the nucleobase editor are expressed in the cell and are joined to form a complete Cas9 protein or a complete nucleobase editor.

It should be appreciated that any rAAV particle, nucleic acid molecule or composition provided herein may be introduced into the cell in any suitable way, either stably or transiently. In some embodiments, the disclosed proteins may be transfected into the cell. In some embodiments, the cell may be transduced or transfected with a nucleic acid molecule. For example, a cell may be transduced (e.g., with a virus encoding a split protein), or transfected (e.g., with a plasmid encoding a split protein) with a nucleic acid molecule that encodes a split protein, or an rAAV particle containing a viral genome encoding one or more nucleic acid molecules. Such transduction may be a stable or transient transduction. In some embodiments, cells expressing a split protein or containing a split protein may be transduced or transfected with one or more guide RNA sequences, for example in delivery of a split Cas9 (e.g., nCas9) protein. In some embodiments, a plasmid expressing a split protein may be introduced into cells through electroporation, transient (e.g., lipofection) and stable genome integration (e.g., nucleofection or piggybac) and viral transduction or other methods known to those of skill in the art.

In some aspects, the invention provides methods comprising delivering one or more base editor-encoding polynucleotides, one or more transcripts thereof, and/or one or proteins transcribed therefrom, to a cell using a non-viral delivery method. Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 1991/17424; WO 1991/16024. Delivery can be to cells (e.g. in vitro or ex vivo administration) or target tissues (e.g. in vivo administration).

In certain embodiments, the compositions provided herein comprise a lipid and/or polymer. In certain embodiments, the lipid and/or polymer is cationic. The preparation of such lipid particles is well known. See, e.g. U.S. Pat. Nos. 4,880,635; 4,906,477; 4,911,928; 4,917,951; 4,920,016; 4,921,757; and 9,737,604, each of which is incorporated herein by reference.

In some embodiments, the target nucleotide sequence is a DNA sequence in a genome, e.g. a eukaryotic genome. In certain embodiments, the target nucleotide sequence is in a mammalian (e.g. a human) genome.

The target nucleotide sequence may comprise a target sequence (e.g., a point mutation) associated with a disease, disorder, or condition. The target sequence may comprise a T to C (or A to G) point mutation associated with a disease, disorder, or condition, and wherein the deamination of the mutant C base results in mismatch repair-mediated correction to a sequence that is not associated with a disease, disorder, or condition. The target sequence may otherwise comprise a G to A (or C to T) point mutation associated with a disease, disorder, or condition, and wherein the deamination of the mutant A base results in mismatch repair-mediated correction to a sequence that is not associated with a disease, disorder, or condition. The target sequence may encode a protein, and where the point mutation is in a codon and results in a change in the amino acid encoded by the mutant codon as compared to a wild-type codon. The target sequence may also be at a splice site, and the point mutation results in a change in the splicing of an mRNA transcript as compared to a wild-type transcript. In addition, the target may be at a non-coding sequence of a gene, such as a promoter, and the point mutation results in increased or decreased expression of the gene.

Thus, in some aspects, the deamination of a mutant C results in a change of the amino acid encoded by the mutant codon, which in some cases can result in the expression of a wild-type amino acid. In other aspects, the deamination of a mutant A results in a change of the amino acid encoded by the mutant codon, which in some cases can result in the expression of a wild-type amino acid.

The methods described herein involving contacting a cell with a composition or rAAV particle can occur in vitro, ex vivo, or in vivo. In certain embodiments, the step of contacting occurs in a subject. In certain embodiments, the subject has been diagnosed with a disease, disorder, or condition.

In some embodiments, the methods disclosed herein involve contacting a mammalian cell with a composition or rAAV particle. In particular embodiments, the methods involve contacting a retinal cell, cortical cell or cerebellar cell.

The split Cas9 protein or split nucleobase editor delivered using the methods described herein preferably have comparable activity compared to the original Cas9 protein or nucleobase editor (i.e., unsplit protein delivered to a cell or expressed in a cell as a whole). For example, the split Cas9 protein or split nucleobase editor retains at least 50% (e.g., at least 50%, at least 60%, at least 70%, at least 80%, at least 90%, at least 95%, at least 98%, at least 99%, or 100%) of the activity of the original Cas9 protein or nucleobase editor. In some embodiments, the split Cas9 protein or split nucleobase editor is more active (e.g., 2-fold, 5-fold, 10-fold, 100-fold, 1000-fold, or more) than that of an original Cas9 protein or nucleobase editor.

The compositions described herein may be administered to a subject in need thereof in a therapeutically effective amount to treat and/or prevent a disease or disorder the subject is suffering from. Any disease or disorder that maybe treated and/or prevented using CRISPR/Cas9-based genome-editing technology may be treated by the split Cas9 protein or the split nucleobase editor described herein. It is to be understood that, if the nucleotide sequences encoding the split Cas9 protein or the nucleobase editor does not further encode a gRNA, a separate nucleic acid vector encoding the gRNA may be administered together with the compositions described herein.

Exemplary suitable diseases, disorders or conditions include, without limitation the disease or disorder is selected from the group consisting of: cystic fibrosis, phenylketonuria, epidermolytic hyperkeratosis (EHK), chronic obstructive pulmonary disease (COPD), Charcot-Marie-Toot disease type 4J, neuroblastoma (NB), von Willebrand disease (vWD), myotonia congenital, hereditary renal amyloidosis, dilated cardiomyopathy, hereditary lymphedema, familial Alzheimer's disease, prion disease, chronic infantile neurologic cutaneous articular syndrome (CINCA), congenital deafness, Niemann-Pick disease type C (NPC) disease, and desmin-related myopathy (DRM). In particular embodiments, the disease or condition is Niemann-Pick disease type C (NPC) disease.

In some embodiments, the disease, disorder or condition is associated with a point mutation in an NPC1 gene, a DNMT1 gene, a PCSK9 gene, or a TMC1 gene. In certain embodiments, the point mutation is a T3182C mutation in NPC1, which results in an I1061T amino acid substitution.

In certain embodiments, the point mutation is an A545G mutation in TMC1, which results in a Y182C amino acid substitution. TMC1 encodes a protein that forms mechanosensitive ion channels in sensory hair cells of the inner ear and is required for normal auditory function. The Y182C amino acid substitution is associated with congenital deafness.

In some embodiments, the disease, disorder or condition is associated with a point mutation that generates a stop codon, for example, a premature stop codon within the coding region of a gene.

Additional exemplary diseases, disorders and conditions include cystic fibrosis (see, e.g., Schwank et al., Functional repair of CFTR by CRISPR/Cas9 in intestinal stem cell organoids of cystic fibrosis patients. *Cell stem cell.* 2013; 13: 653-658; and Wu et. al., Correction of a genetic disease in mouse via use of CRISPR-Cas9. *Cell stem cell.* 2013; 13: 659-662, neither of which uses a deaminase fusion protein to correct the genetic defect); phenylketonuria—e.g., phenylalanine to serine mutation at position 835 (mouse) or 240 (human) or a homologous residue in phenylalanine hydroxylase gene (T>C mutation) —see, e.g., McDonald et al., *Genomics.* 1997; 39:402-405; Bernard-Soulier syndrome (BSS) —e.g., phenylalanine to serine mutation at position 55 or a homologous residue, or cysteine to arginine at residue 24 or a homologous residue in the platelet membrane glycoprotein IX (T>C mutation) —see, e.g., Noris et al., *British Journal of Haematology.* 1997; 97: 312-320, and Ali et al., *Hematol.* 2014; 93: 381-384; epidermolytic hyperkeratosis (EHK) —e.g., leucine to proline mutation at position 160 or 161 (if counting the initiator methionine) or a homologous residue in keratin 1 (T>C mutation) —see, e.g., Chipev et al., *Cell.* 1992; 70: 821-828, see also accession number P04264 in the UNIPROT database at www[dot] uniprot[dot]org; chronic obstructive pulmonary disease (COPD) —e.g., leucine to proline mutation at position 54 or 55 (if counting the initiator methionine) or a homologous residue in the processed form of $\alpha_1$-antitrypsin or residue 78 in the unprocessed form or a homologous residue (T>C mutation) —see, e.g., Poller et al., *Genomics.* 1993; 17: 740-743, see also accession number P01011 in the UNIPROT database; Charcot-Marie-Toot disease type 4J—e.g., isoleucine to threonine mutation at position 41 or a homologous residue in FIG. 4 (T>C mutation) —see, e.g., Lenk et al., PLoS Genetics. 2011; 7: e1002104; neuroblastoma (NB) —e.g., leucine to proline mutation at position 197 or a homologous residue in Caspase-9 (T>C mutation) —see, e.g., Kundu et al., 3 *Biotech.* 2013, 3:225-234; von Willebrand disease (vWD) —e.g., cysteine to arginine mutation at position 509 or a homologous residue in the processed form of von Willebrand factor, or at position 1272 or a homologous residue in the unprocessed form of von Willebrand factor (T>C mutation) —see, e.g., Lavergne et al., *Br. J. Haematol.* 1992, see also accession number P04275 in the UNIPROT database; 82: 66-72; myotonia congenital—e.g., cysteine to arginine mutation at position 277 or a homologous residue in the muscle chloride channel gene CLCN1 (T>C mutation) —see, e.g., Weinberger et al., *The J. of Physiology.* 2012; 590: 3449-3464; hereditary renal amyloidosis—e.g., stop codon to arginine mutation at position 78 or a homologous residue in the processed form of apolipoprotein AII or at position 101 or a homologous residue in the unprocessed form (T>C mutation) —see, e.g., Yazaki et al., *Kidney Int.* 2003; 64: 11-16; dilated cardiomyopathy (DCM) —e.g., tryptophan to Arginine mutation at position 148 or a homologous residue in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 or a homologous residue in VEGFR3 tyrosine kinase (A>G mutation), see, e.g., Irrthum et al., *Am. J. Hum. Genet.* 2000; 67: 295-301; familial Alzheimer's disease—e.g., isoleucine to valine mutation at position 143 or a homologous residue in presenilinl (A>G mutation), see, e.g., Gallo et. al., *J. Alzheimer's disease.* 2011; 25: 425-431; Prion disease—e.g., methionine to valine mutation at position 129 or a homologous residue in prion protein (A>G mutation) —see, e.g., Lewis et. al., *J. of General Virology.* 2006; 87: 2443-2449; chronic infantile neurologic cutaneous articular syndrome (CINCA) —e.g., Tyrosine to Cysteine mutation at position 570 or a homologous residue in cryopyrin (A>G mutation) —see, e.g., Fujisawa et. al. *Blood.* 2007; 109: 2903-2911; and desmin-related myopathy (DRM) —e.g., arginine to glycine mutation at position 120 or a homologous residue in $\alpha\beta$ crystallin (A>G mutation) —see, e.g., Kumar et al., *J. Biol. Chem.* 1999; 274: 24137-24141. The entire contents of all references and database entries is incorporated herein by reference.

Suitable routes of administrating the composition for pain suppression include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, parenteral, and intracerebroventricular administration.

The compositions of this disclosure may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent, i.e., a carrier or vehicle.

Treatment of a disease or disorder includes delaying the development or progression of the disease, or reducing disease severity. Treating the disease does not necessarily require curative results.

As used therein, “delaying” the development of a disease means to defer, hinder, slow, retard, stabilize, and/or postpone progression of the disease. This delay can be of varying lengths of time, depending on the history of the disease and/or individuals being treated. A method that “delays” or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

“Development” or “progression” of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. “Development” includes occurrence, recurrence, and onset.

As used herein “onset” or “occurrence” of a disease includes initial onset and/or recurrence. Conventional methods, known to those of ordinary skill in the art of medicine, can be used to administer the isolated polypeptide or pharmaceutical composition to the subject, depending upon the type of disease to be treated or the site of the disease.

In some aspects, the present disclosure provides uses of any one of the split nucleobase editors described herein and a guide RNA targeting this nucleobase editor to a target in the manufacture of a medicament. In some aspects, uses of any one of the nucleobase editors and guide RNAs described herein are provided in the manufacture of a kit for base editing, wherein the base editing comprises contacting the nucleic acid molecule with the split nucleobase editor and guide RNA under conditions suitable for the substitution of the adenine (A) of a A:T nucleobase pair in the target with a guanine (G), or for the substitution of the cytosine (C) of a C:T nucleobase pair in the target with a thymine (T). In some embodiments, the step of contacting of induces separation of the double-stranded DNA at a target region. In some embodiments, the step of contacting further comprises nicking one strand of the double-stranded DNA, wherein the one strand comprises an unmutated strand.

In some embodiments of the described uses, the step of contacting is performed in vitro. In other embodiments, the step of contacting is performed in vivo. In some embodiments, the step of contacting is performed in a subject (e.g., a human subject or a non-human animal subject). In some embodiments, the step of contacting is performed in a cell, such as a human or non-human animal cell.

The present disclosure also provides uses of any one of the nucleobase editors or any one of the complexes of nucleobase editors and guide RNAs described herein as a medicament. The present disclosure also provides uses of the described pharmaceutical compositions or cells comprising, and vectors or rAAV particles encoding, any of the disclosed nucleobase editors or complexes herein as a medicament. In particular embodiments, the medicament is for treatment of Niemann-Pick disease type C (NPC) disease, congenital deafness, or hearing loss.

Kits

The compositions of the present disclosure may be assembled into kits. In some embodiments, the kit comprises nucleic acid vectors for the expression of the nucleobase editors described herein. In some embodiments, the kit further comprises appropriate guide nucleotide sequences (e.g., gRNAs) or nucleic acid vectors for the expression of such guide nucleotide sequences, to target the Cas9 protein or nucleobase editor to the desired target sequence.

The kit described herein may include one or more containers housing components for performing the methods described herein and optionally instructions for use. Any of the kit described herein may further comprise components needed for performing the assay methods. Each component of the kits, where applicable, may be provided in liquid form (e.g., in solution) or in solid form, (e.g., a dry powder). In certain cases, some of the components may be reconstitutable or otherwise processible (e.g., to an active form), for example, by the addition of a suitable solvent or other species (for example, water), which may or may not be provided with the kit.

In some embodiments, the kits may optionally include instructions and/or promotion for use of the components provided. As used herein, “instructions” can define a component of instruction and/or promotion, and typically involve written instructions on or associated with packaging of the disclosure. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use, or sale of pharmaceuticals or biological products, which can also reflect approval by the agency of manufacture, use or sale for animal administration. As used herein, “promoted” includes all methods of doing business including methods of education, hospital and other clinical instruction, scientific inquiry, drug discovery or development, academic research, pharmaceutical industry activity including pharmaceutical sales, and any advertising or other promotional activity including written, oral and electronic communication of any form, associated with the disclosure. Additionally, the kits may include other components depending on the specific application, as described herein.

The kits may contain any one or more of the components described herein in one or more containers. The components may be prepared sterilely, packaged in a syringe and shipped refrigerated. Alternatively it may be housed in a vial or other container for storage. A second container may have other components prepared sterilely. Alternatively the kits may include the active agents premixed and shipped in a vial, tube, or other container.

The kits may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kits may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kits may also include other components, depending on the specific application, for example, containers, cell media, salts, buffers, reagents, syringes, needles, a fabric, such as gauze, for applying or removing a disinfecting agent, disposable gloves, a support for the agents prior to administration, etc.

Host Cells

Cells that may contain any of the compositions described herein include prokaryotic cells and eukaryotic cells. The methods described herein are used to deliver a Cas9 protein or a nucleobase editor into a eukaryotic cell (e.g., a mammalian cell, such as a human cell). In some embodiments, the cell is in vitro (e.g., cultured cell. In some embodiments, the cell is in vivo (e.g., in a subject such as a human subject). In some embodiments, the cell is ex vivo (e.g., isolated from a subject and may be administered back to the same or a different subject).

Mammalian cells of the present disclosure include human cells, primate cells (e.g., vero cells), rat cells (e.g., GH3 cells, OC23 cells) or mouse cells (e.g., MC3T3 cells). There are a variety of human cell lines, including, without limitation, human embryonic kidney (HEK) cells, HeLa cells, cancer cells from the National Cancer Institute's 60 cancer cell lines (NCI60), DU145 (prostate cancer) cells, Lncap (prostate cancer) cells, MCF-7 (breast cancer) cells, MDA-MB-438 (breast cancer) cells, PC3 (prostate cancer) cells, T47D (breast cancer) cells, THP-1 (acute myeloid leukemia) cells, U87 (glioblastoma) cells, SHSY5Y human neuroblastoma cells (cloned from a myeloma) and Saos-2 (bone cancer) cells. In some embodiments, rAAV vectors are delivered into human embryonic kidney (HEK) cells (e.g., HEK 293 or HEK 293T cells). In some embodiments, rAAV vectors are delivered into stem cells (e.g., human stem cells) such as, for example, pluripotent stem cells (e.g., human pluripotent stem cells including human induced pluripotent stem cells (hiPSCs)). A stem cell refers to a cell with the ability to divide for indefinite periods in culture and to give rise to specialized cells. A pluripotent stem cell refers to a type of stem cell that is capable of differentiating into all tissues of an organism, but not alone capable of sustaining full organismal development. A human induced pluripotent stem cell refers to a somatic (e.g., mature or adult) cell that has been reprogrammed to an embryonic stem cell-like state by being forced to express genes and factors important for maintaining the defining properties of embryonic stem cells (see, e.g., Takahashi and Yamanaka, *Cell* 126 (4): 663-76, 2006, incorporated by reference herein). Human induced pluripotent stem cell cells express stem cell markers and are capable of generating cells characteristic of all three germ layers (ectoderm, endoderm, mesoderm).

Additional non-limiting examples of cell lines that may be used in accordance with the present disclosure include 293-T, 293-T, 3T3, 4T1, 721, 9L, A-549, A172, A20, A253, A2780, A2780ADR, A2780cis, A431, ALC, B16, B35, BCP-1, BEAS-2B, bEnd.3, BHK-21, BR 293, BxPC3, C2C12, C3H-10T1/2, C6, C6/36, Cal-27, CGR8, CHO, CML T1, CMT, COR-L23, COR-L23/5010, COR-L23/CPR, COR-L23/R23, COS-7, COV-434, CT26, D17, DH82, DU145, DuCaP, E14Tg2a, EL4, EM2, EM3, EMT6/AR1, EMT6/AR10.0, FM3, H1299, H69, HB54, HB55, HCA2, Hepalclc7, High Five cells, HL-60, HMEC, HT-29, HUVEC, J558L cells, Jurkat, JY cells, K562 cells, KCL22, KG1, Ku812, KYO1, LNCap, Ma-Mel 1, 2, 3 . . . 48, MC-38, MCF-10A, MCF-7, MDA-MB-231, MDA-MB-435, MDA-MB-468, MDCK II, MG63, MONO-MAC 6, MOR/0.2R, MRCS, MTD-1A, MyEnd, NALM-1, NCI-H69/CPR, NCI-H69/LX10, NCI-H69/LX20, NCI-H69/LX4, NIH-3T3, NW-145, OPCN/OPCT Peer, PNT-1A/PNT 2, PTK2, Raji, RBL cells, RenCa, RIN-5F, RMA/RMAS, S2, Saos-2 cells, Sf21, Sf9, SiHa, SKBR3, SKOV-3, T-47D, T2, T84, THP1, U373, U87, U937, VCaP, WM39, WT-49, X63, YAC-1 and YAR cells.

Without further elaboration, it is believed that one skilled in the art can, based on the above description, utilize the present disclosure to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

In order that the invention described herein may be more fully understood, the following examples are set forth. The synthetic examples described in this application are offered to illustrate the compounds and methods provided herein and are not to be construed in any way as limiting their scope.

Example 1: AAV Delivery of Split Nucleobase Editor

This study was designed to show that a nucleobase editor may be delivered by recombinant AAV (rAAV) in two sections, which may be joined to form a complete and active nucleobase editor in cells via protein splicing. Different elements of the rAAV constructs were tested for optimized nucleobase editor expression and activity.

Recombinant AAV (rAAV) is widely used for transgene delivery. Transgenes were inserted into the AAV genome between the inverted terminal repeat (ITR) sequences and packaged into AAV viral particles, which are used to transduce a host cell (e.g., mammalian cell, human cell). However, there is a limitation on the size of the transgene that may be packaged into rAAV, typically approximately 4.9 kilobases. Nucleic acids encoding a nucleobase editor (e.g., cytosine deaminase-dCas9-UGI) typically exceed the packaging limit of rAAV. As described herein, the nucleic acids encoding a nucleobase editor were split (see FIG. 1A), and each section was packaged into a separate rAAV particle. The two sections of the nucleobase editor were delivered to the cells and can be ligated to form a complete nucleobase editor via protein splicing (e.g., mediated by an intein, such as the DnaE intein; see FIG. 1C). The ligated, complete nucleobase editor was active in editing target bases (see FIG. 1B). The rAAV constructs encoding the split nucleobase editors were tested in different cell lines, e.g., U118 and HEK293T, and are active in editing the target base (see FIGS. 3A-3B and FIGS. 5A-5B).

Figure 4:
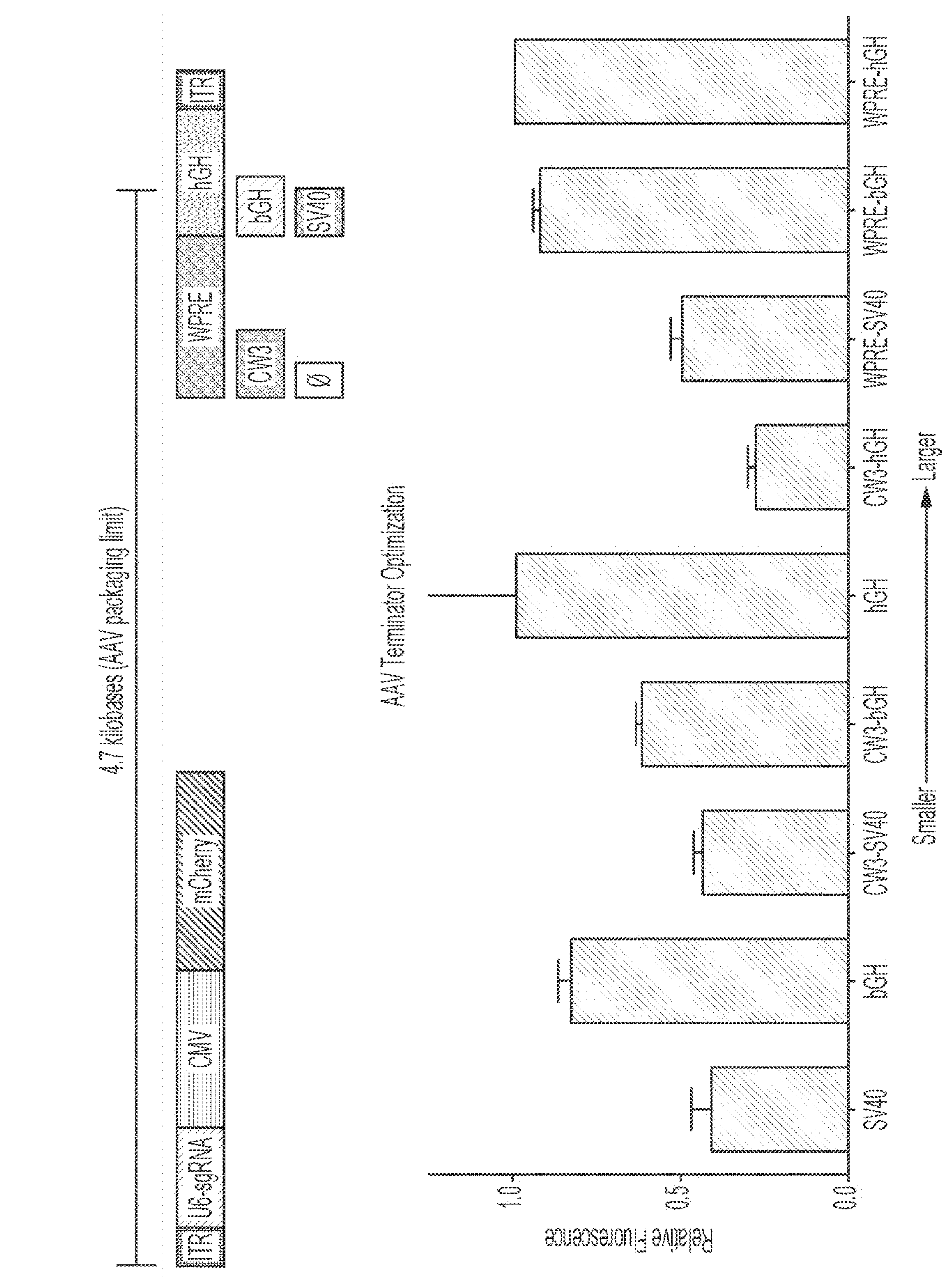
FIG. 4 is a graph showing the optimization of the transcriptional terminator used in the AAV constructs encoding the split nucleobase editor. Transcriptional terminators of different sizes and origins were tested. bGH transcriptional terminator is relatively short and efficiently terminates transcription comparably to longer terminator sequences. It was therefore chosen to be used in the downstream experiments.
Figure 5A:
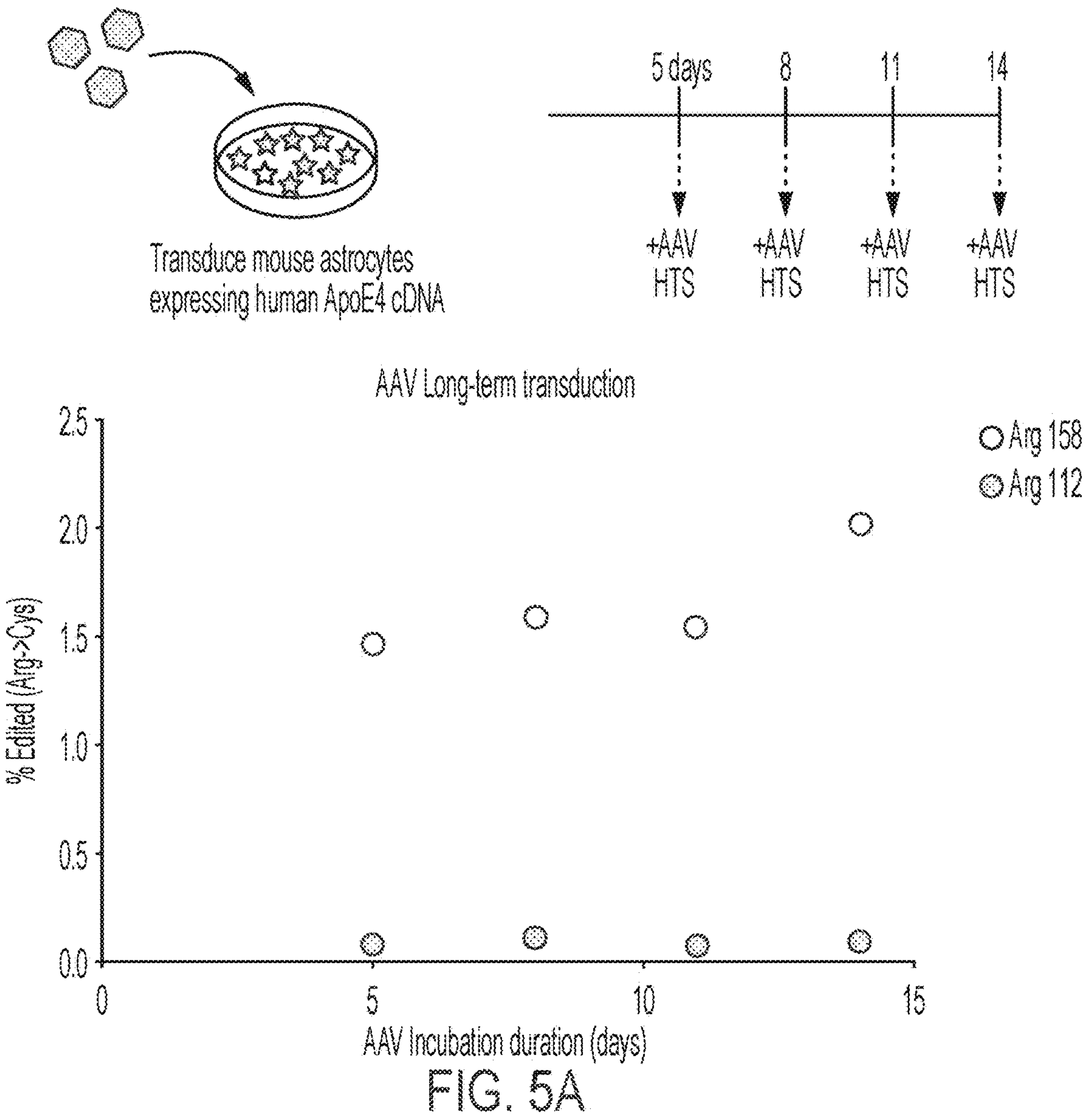
FIGS. 5A-5B are graphs showing the results of nucleobase editing with long term (up to 15 days) transduction of AAV encoding the split nucleobase editor in mouse astrocytes expressing human ApoE4 cDNA. The target base is in the codon for arginine 112 and arginine 158 in ApoE4, which is converted to a cysteine upon base editing.
Figure 5B:
Figure 6:
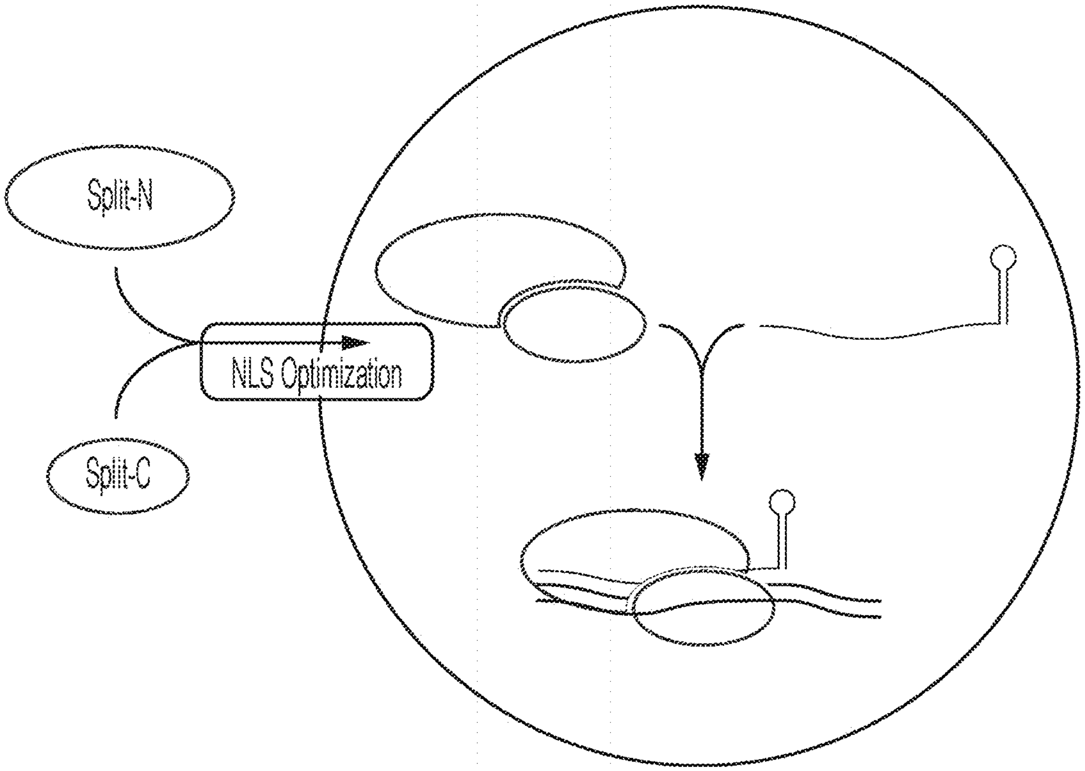
FIG. 6 is a schematic representation of the optimization of the nuclear localization signal in AAV constructs encoding the split nucleobase editor. The nuclear localization signal controls nuclear import, which must occur for reconstituted nucleobase editor to associate with genomic DNA as a prerequisite for editing, and is a potential rate-limiting step in the process. This schematic shows that the NLS (and NLS optimization) is critical for the nucleobase editor to be imported into the nucleus.
Figure 7:
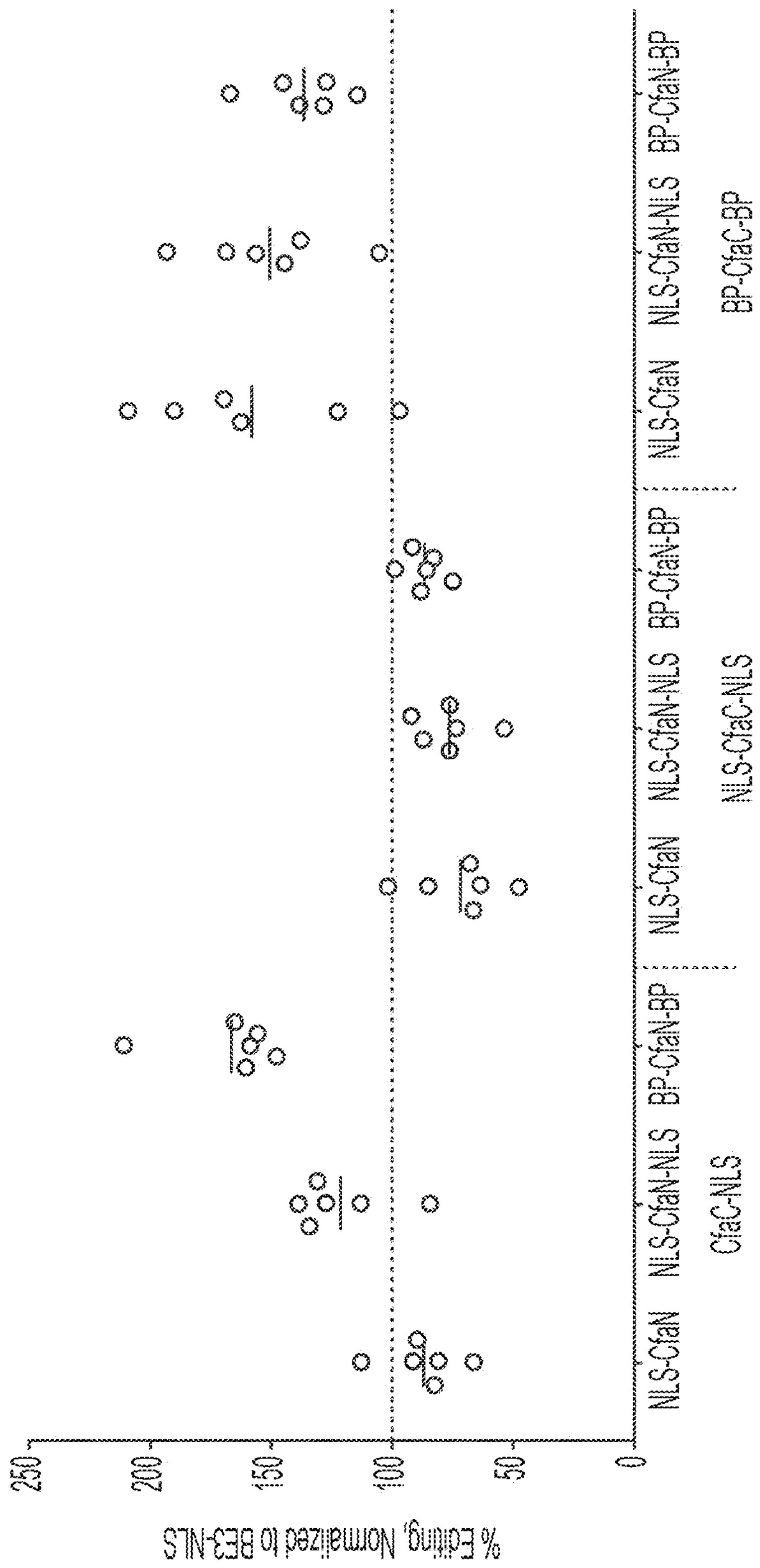
FIG. 7 is a graph showing the results of base editing using different rAAV split nucleobase editor constructs containing different nuclear localization signals (NLS).

Different transcriptional terminators and nuclear localization signals (NLS) were tested in the rAAV constructs to optimize the expression and activity of the nucleobase editors (see FIGS. 4, 6, and 7).

Figure 1B:
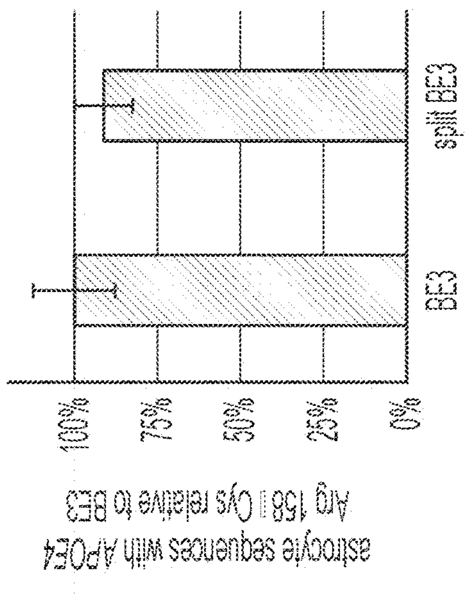
Figure 1C:
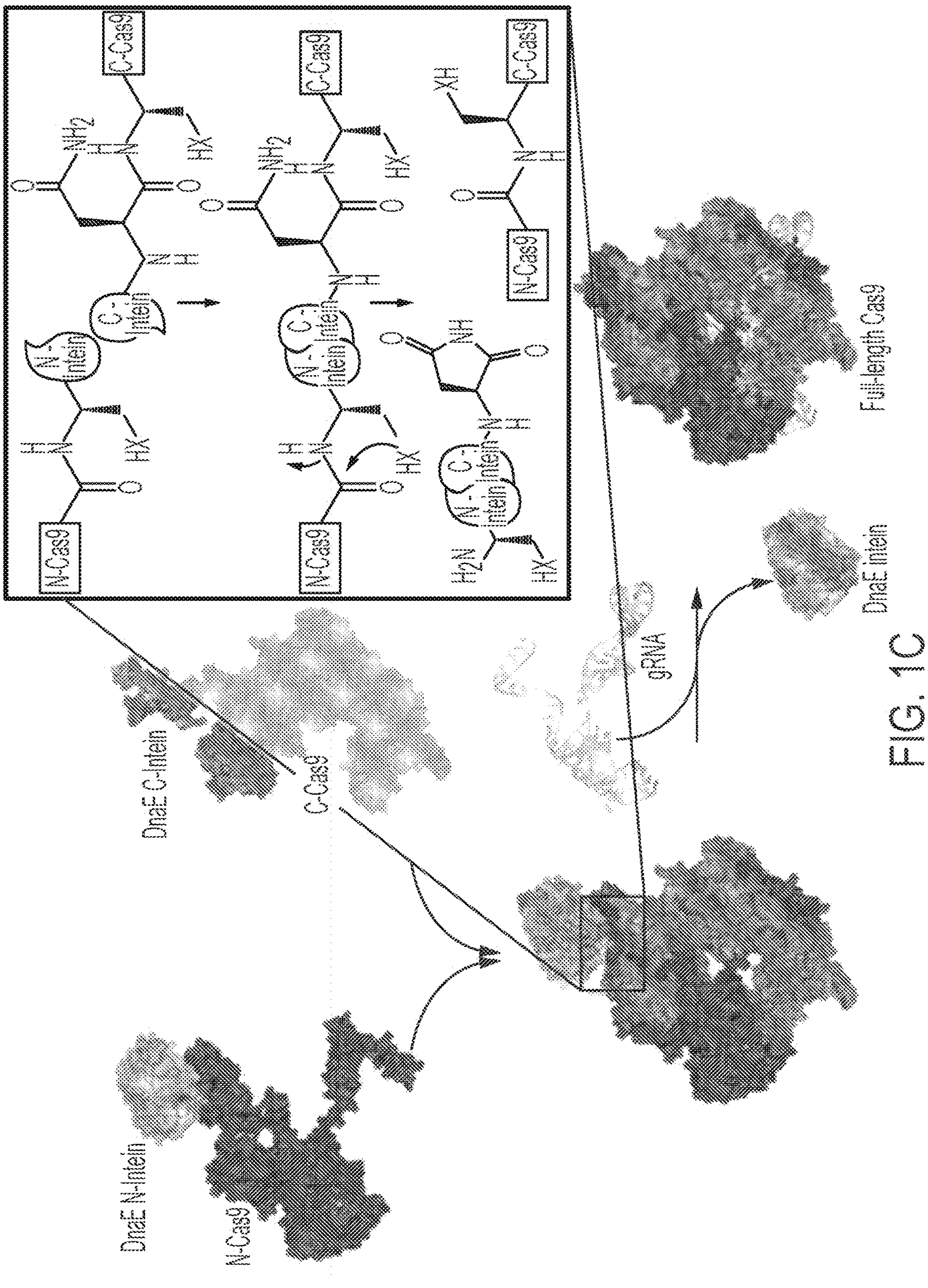
Figure 2:
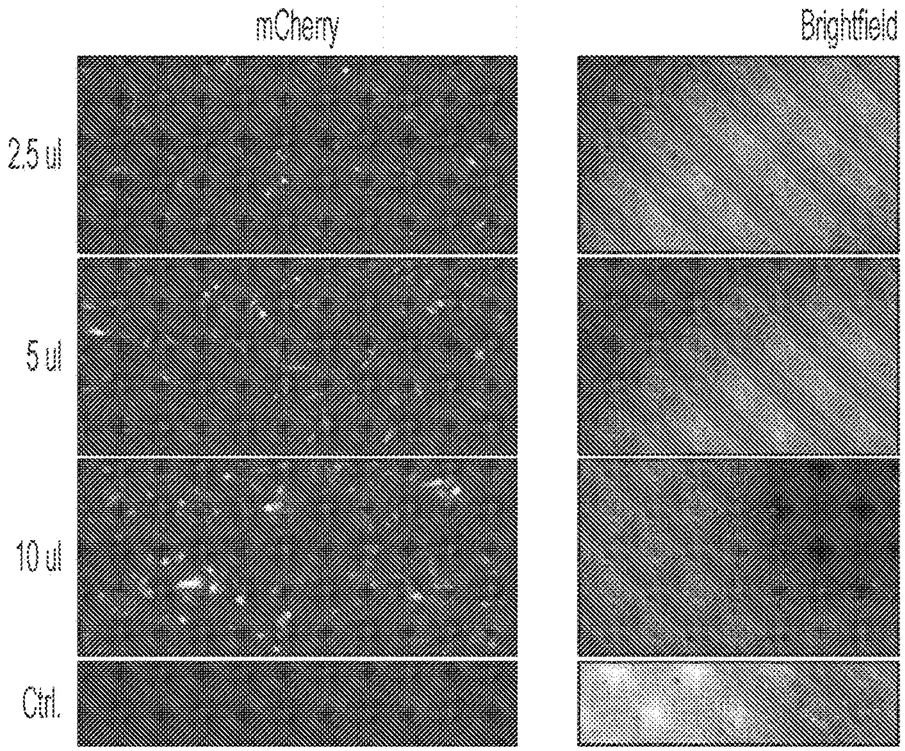
FIG. 2 shows that U1118 cells were efficiently transfected by AAV2 containing nucleic acids encoding mCherry. Different viral titers were tested (2.5-10 μl at $4.5\times10^{11}$ vg/ml*) and all resulted in efficient transfection of U118 cells. *vg/ml means viral genome-containing particles per microliter.
Figure 3A:
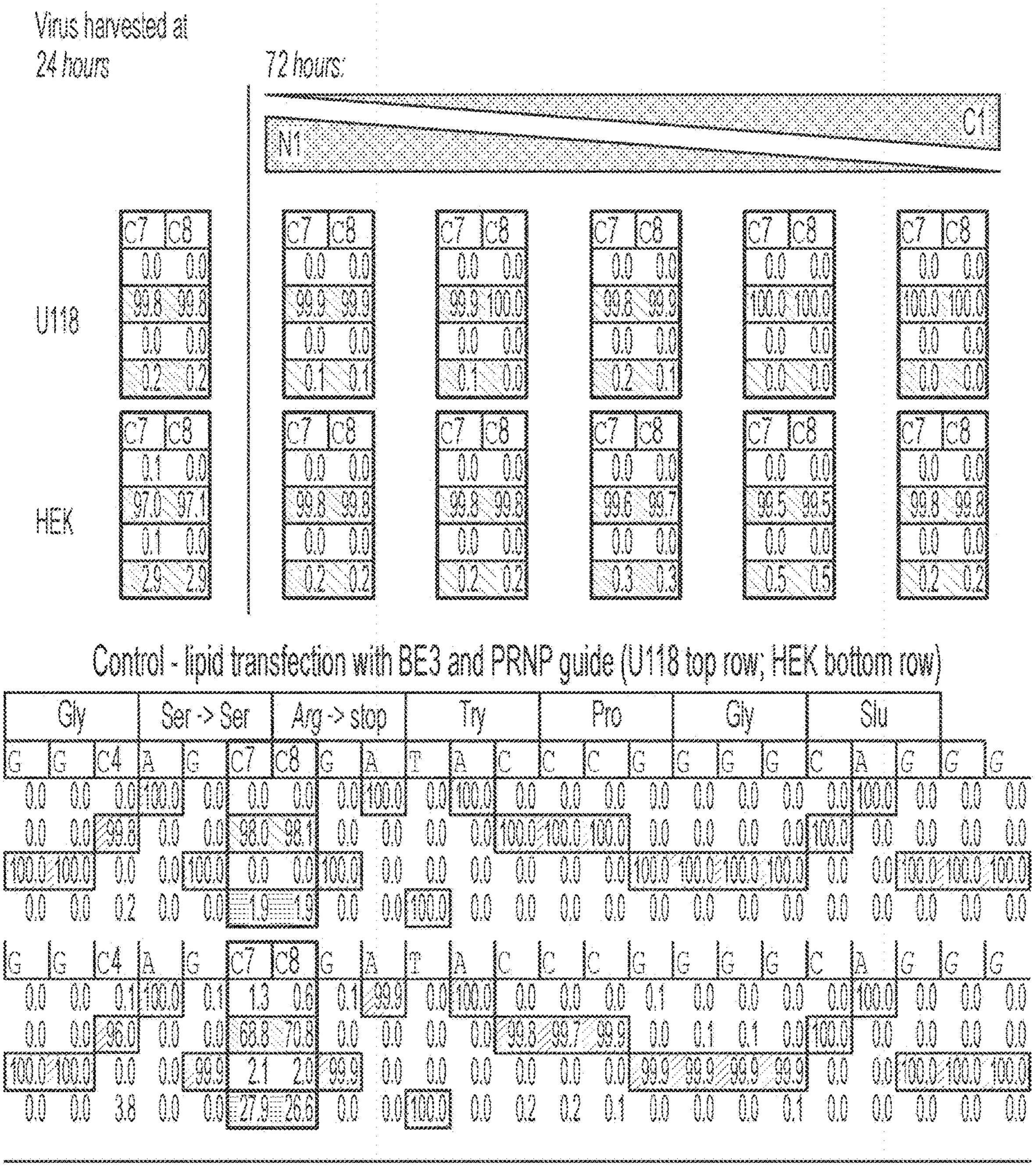
FIGS. 3A-3B are graphs showing high throughput sequence (HTS) results of nucleobase editing by rAAV-delivered split nucleobase editor in U118 and HEK cells. Lipid-transfected nucleobase editor was used as a control. A sgRNA targeting R37 in the PRNP gene was used, and the PRNP gene locus was sequenced.
Figure 3B:
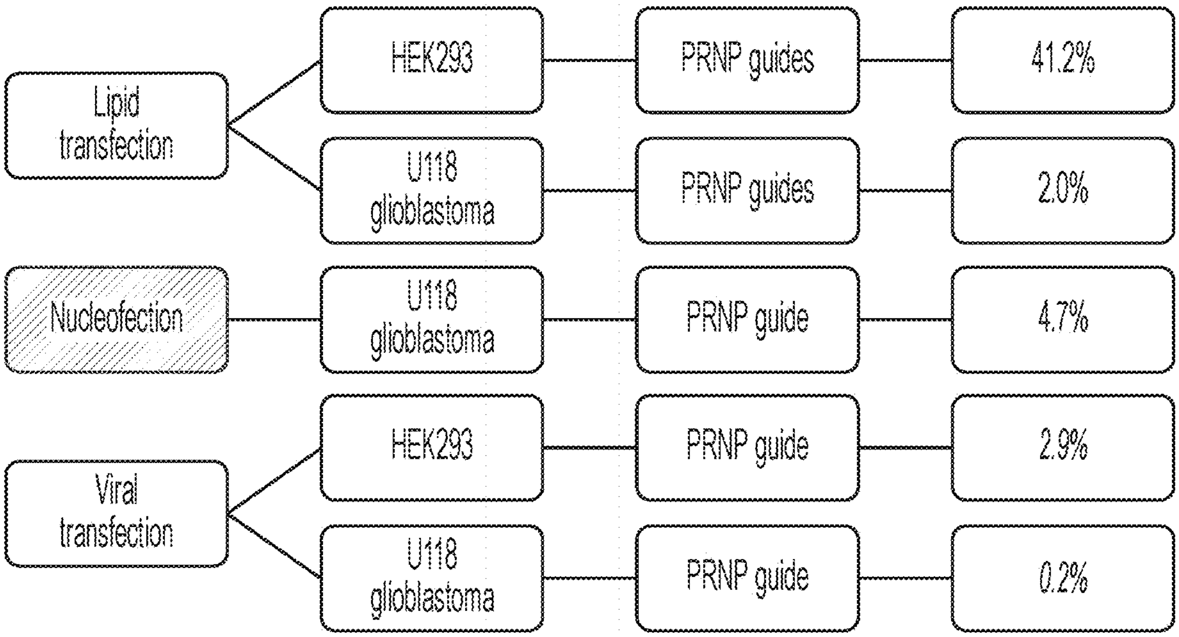

Example 2: Editing of DNMT1 Gene in Mouse Neuron Using AAV Encoded Split Nucleobase Editor This study was designed to test the base editing activity of an AAV encoded split nucleobase editor in vivo. A split nucleobase editor as shown in FIG. 1A was used. The amino acid sequence of the linker between the dCas9 domain and the deaminase domain is SGGSSGGSSGSETPGTSESATPESSGGSSGGS (SEQ ID NO: 384). A guide RNA targeting a well-characterized site in the DNMT1 gene was selected.

It was expected that the cells would be able to tolerate the editing. These experiments aim to determine whether AAV encoded split nucleobase editor can edit the locus in vitro or in vivo in several cell types including primary neurons.

Figure 8A:
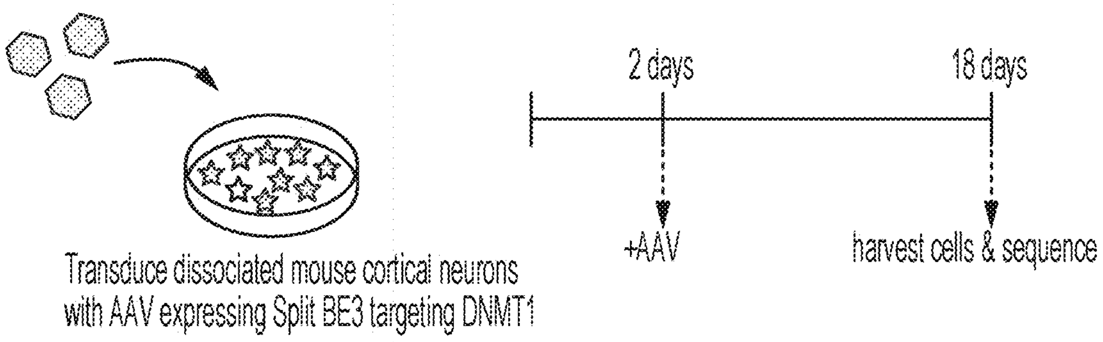
FIGS. 8A-8B are graphs showing the editing of DNMT1 gene in dissociated mouse cortical neurons using an AAV encoded split nucleobase editor.
Figure 8B:
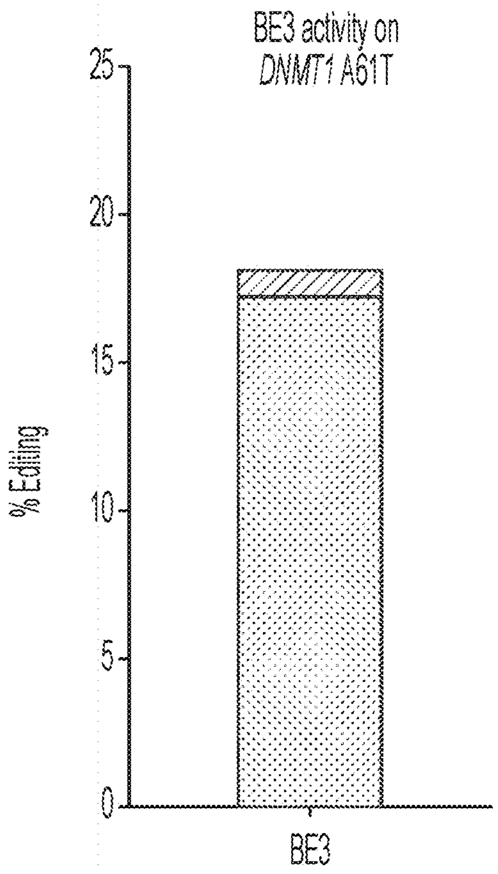

In one experiment, AAV vectors encoding the split nucleobase editor and a guide RNA targeting DNMT1 were used to transduce dissociated mouse cortical neurons, two days after the cortical neurons were isolated and cultured. The neurons were harvested 16 days post transduction and the DNMT1 gene was sequenced (FIG. 8A) to determine editing efficiency as well as off-target effects. An editing efficiency of 17.34% (C to T editing, darker grey in FIG. 8B) was detected, while only 0.82% of undesired editing (C to G or C to A change, lighter grey in FIG. 8B) was detected.

Figure 9A:
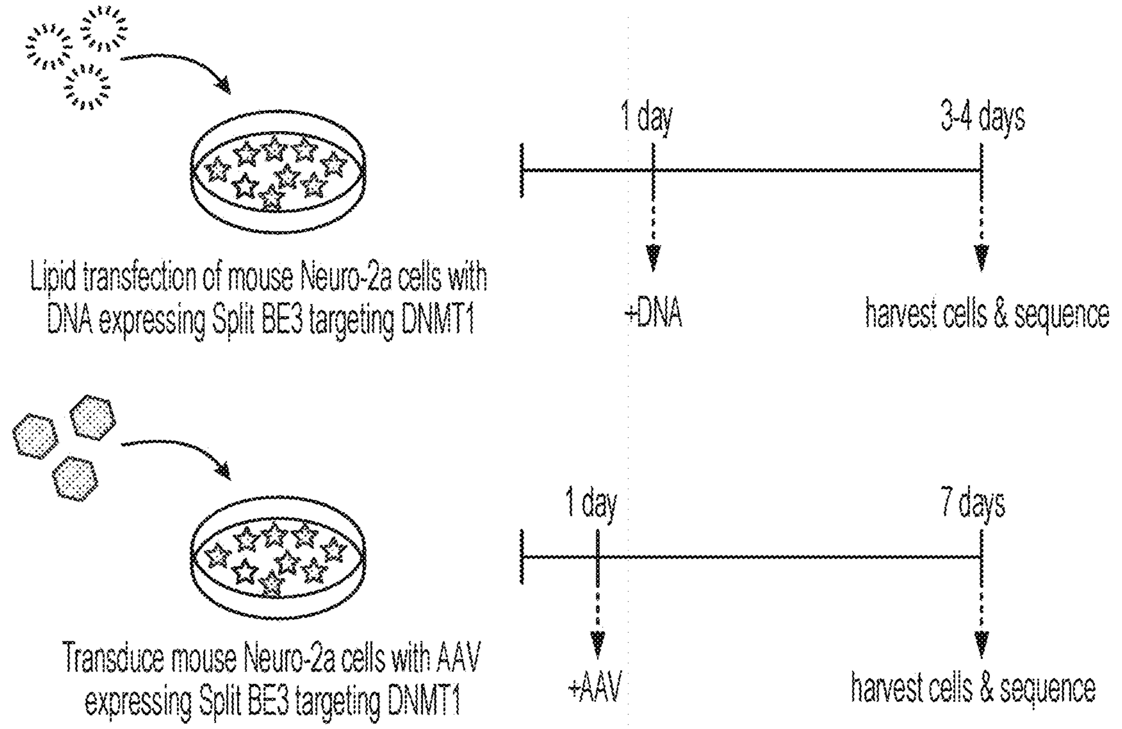
FIGS. 9A-9B are graphs showing the editing of DNMT1 gene in mouse Neuro-2a cell line using either an AAV encoded split nucleobase editor, or a lipid transfected DNA encoded nucleobase editor.
Figure 9B:
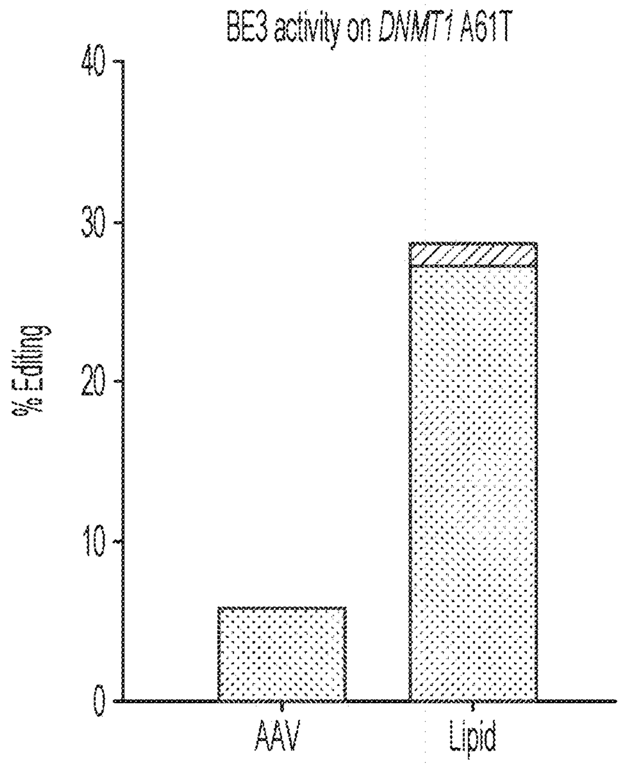

In another experiment, cultured mouse Neuro-2 cells were either transduced with AAV vectors encoding the split nucleobase editor and a guide RNA targeting DNMT1, or transfected with lipid-encapsulated DNA encoding the nucleobase editor and guide RNA, allowing direct comparison of editing efficiency using different delivery methods of the nucleobase editor (FIG. 9A). An editing efficiency of 5.96% (C to T editing, dark grey in FIG. 9B) was observed for AAV encoded split nucleobase editor, while an editing efficiency of 27.3% (C to T editing, dark grey in FIG. 9B) was observed for lipid-transfected DNA encoded nucleobase editor. The amount of undesired products was 0.15% for AAV encoded split nucleobase editor and 1.3% for lipid-transfected DNA encoded nucleobase editor (C to G or C to A change, lighter grey in FIG. 9B).

Figure 10A:
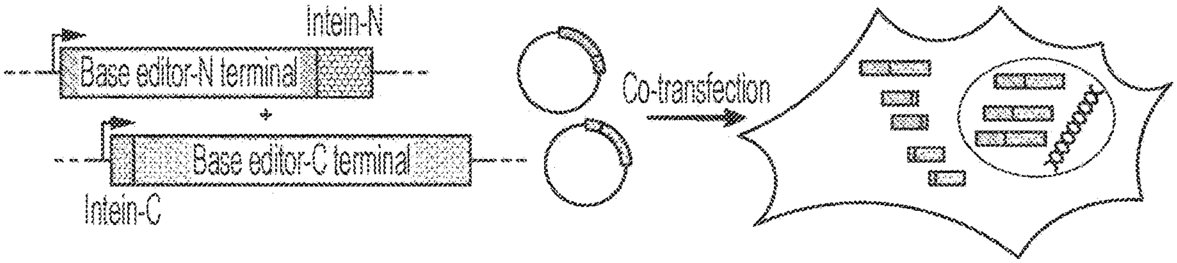
FIGS. 10A-10F show the development of split-intein cytosine and adenine base editors (or nucleobase editors).

Example 3: AAV-Mediated Central Nervous System, Liver, Heart, and Muscle Delivery of Cytosine and Adenine Nucleobase Editors Results Development of a Split-Intein Approach to CBE and ABE Reconstitution It was reasoned that the use of a trans-splicing intein would enable CBE and ABE to be divided into halves that are each smaller than the AAV packaging size limit, enabling dual AAV packaging of nucleobase editors (FIG. 10A). To generate a split-intein CBE, each split DnaE intein half from *Nostoc punctiforme* (Npu)[18] was fused to each half of the original CBE BE3, dividing BE3 within the *S. pyogenes* Cas9 domain[15,19] immediately before Cys 574 or Thr 638. It was observed that dividing BE3 just before Cys 574 with the split Npu intein (referred to hereafter as the Npu-BE3 construct), resulted in robust on-target base editing (34±6.4% average editing by high-throughput sequencing among unsorted cells targeting six genomic loci, FIG. 10B) in HEK293T cells following co-transfection of plasmids expressing each split half, plus a third plasmid expressing sgRNA. Notably, target C·G-to-T·A editing efficiency was higher, rather than lower, than editing levels following transfection of a plasmid expressing an intact BE3, which resulted in an average of 22±7.9% editing across the six sites (FIGS. 10B and 10C), indicating that intein splicing at Cys 574 does not limit editing efficiency in this system. It is believed that higher expression levels of each split-intein nucleobase editor half, relative to that of the much larger intact nucleobase editor proteins, may account for increased editing from split-intein nucleobase editors. Interestingly, the second tested BE3 split site, ahead of Thr 638, did not support robust base editing (averaging 10±10% editing across six sites) even though both split sites support Cas9 nuclease activity[15], suggesting that nucleobase editors impose additional requirements for productive intein splicing or productive editing compared to Cas9 nuclease.

Figure 10B:
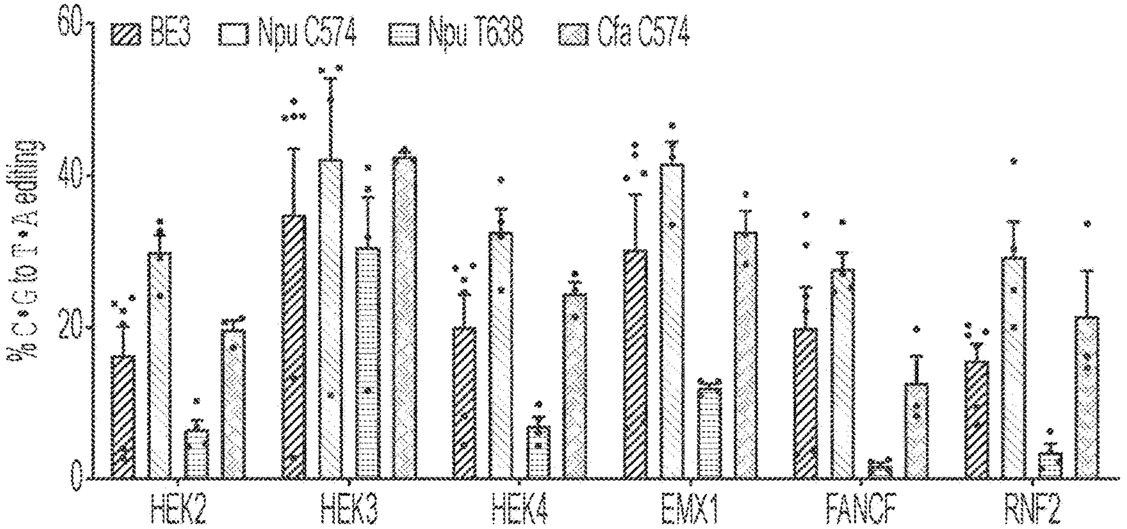
Figure 10C:
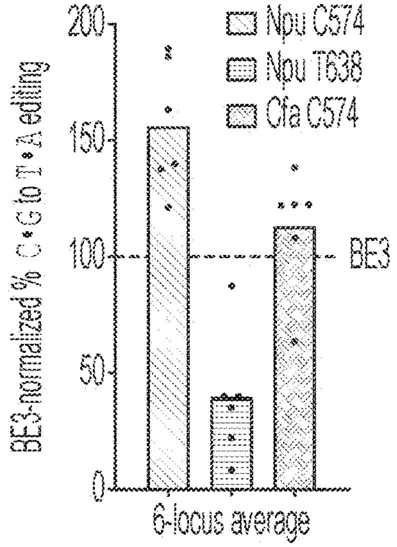
Figure 10D:
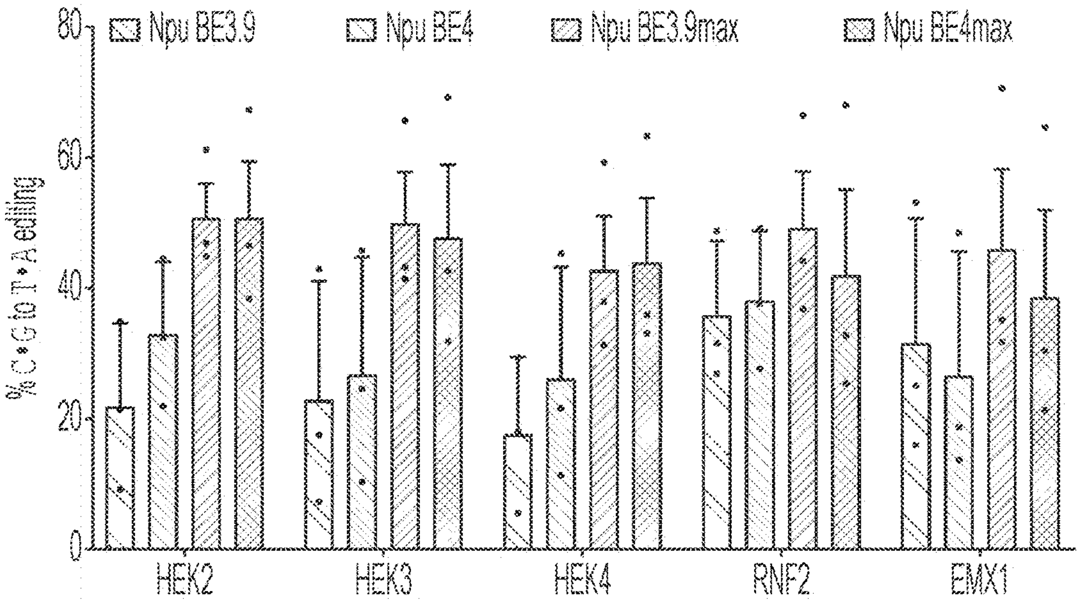
Figure 10E:
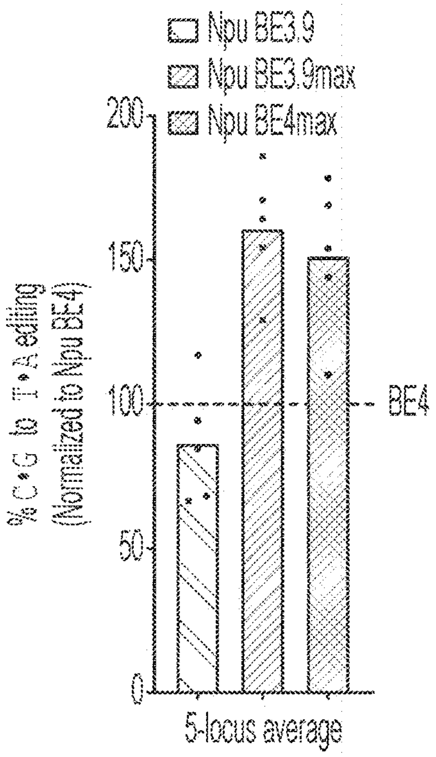

After identifying a BE3 split site that does not impair base editing efficiencies following intein splicing, split-intein CBE performance was optimized. The performance of the Npu split intein was compared with that of Cfa, a synthetic split intein developed from the consensus sequences of fast-splicing DnaE homologs from a variety of organisms[20]. Npu-BE3 outperformed Cfa-BE3, which resulted in 25±10% average base editing (FIGS. 10B and 10C). To incorporate recent architectural improvements in the newer BE4 nucleobase editor[5], as well as improved expression and nuclear localization of BE4max[6], Npu-BE4 constructs were generated and two codon usages were tested. Consistent with the recent report[6], it was observed that codon and nuclear localization signal (NLS) optimization of Npu-BE4max resulted in higher base editing efficiencies than Npu-BE4 using IDT codon optimization (44±4.2% editing vs. 26±3.0% editing, FIG. 10D). It was also found that the second UGI domain did not increase the editing efficiency of Npu-BE4max; a single UGI in the BEmax architecture yields 48±3.0% editing (FIGS. 10D and 10E). In light of these results, the second UGI was omitted from future AAV constructs to minimize viral genome size, resulting in a spliced NLS- and codon-optimized APOBEC-Cas9 nickase-UGI construct that is referred to hereafter as CBE3.9max.

Figure 10F:
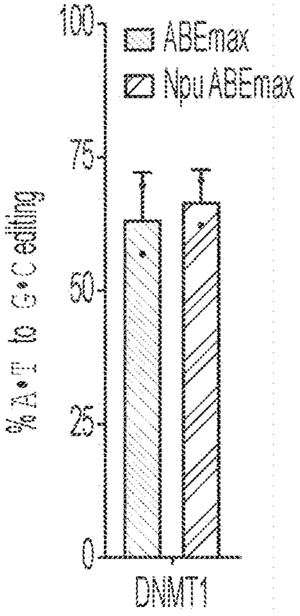

Using the Cys 574 Cas9 split site and the Npu split intein, a split optimized adenine nucleobase editor (Npu-ABEmax) construct was also generated that reconstitutes ABEmax[6] activity to edit a test site in the mouse DNMT1 gene (63±5.4% A·T-to-G·C editing from Npu-ABEmax, compared to 63±6.3% editing from non-split ABEmax, FIG. 10F). Finally, seven split sites were screened in *S. aureus* Cas9-BE3 (SaBE3)[21], and a site was identified immediately before Cys 535 that fully recapitulated unsplit SaBE3 activity in HEK293T cells (FIGS. 16A-16F). A recent report demonstrated that another intein split site, preceding Ser 740, reconstitutes full-length SaCas9 nuclease activity and supports split Sa-BE3 activity in vivo[22]. Together, these results establish optimized split-intein CBE and ABE halves that, upon protein splicing, reconstitute cytosine and adenine nucleobase editors with no apparent loss in editing efficiency.

Development of Split-Intein CBE and ABE AAV

After developing a viable way to divide both classes of nucleobase editors into split intein-fused halves, a series of AAV particles was generated and characterized to optimize base editing efficiency and minimize AAV genome size to support efficient AAV production[23]. Several post-transcriptional regulatory element sequences (PREs) and sgRNA positions were tested in the context of AAV, rather than plasmid delivery, to maximize the in vivo relevance of the optimization process.

Figure 11A:
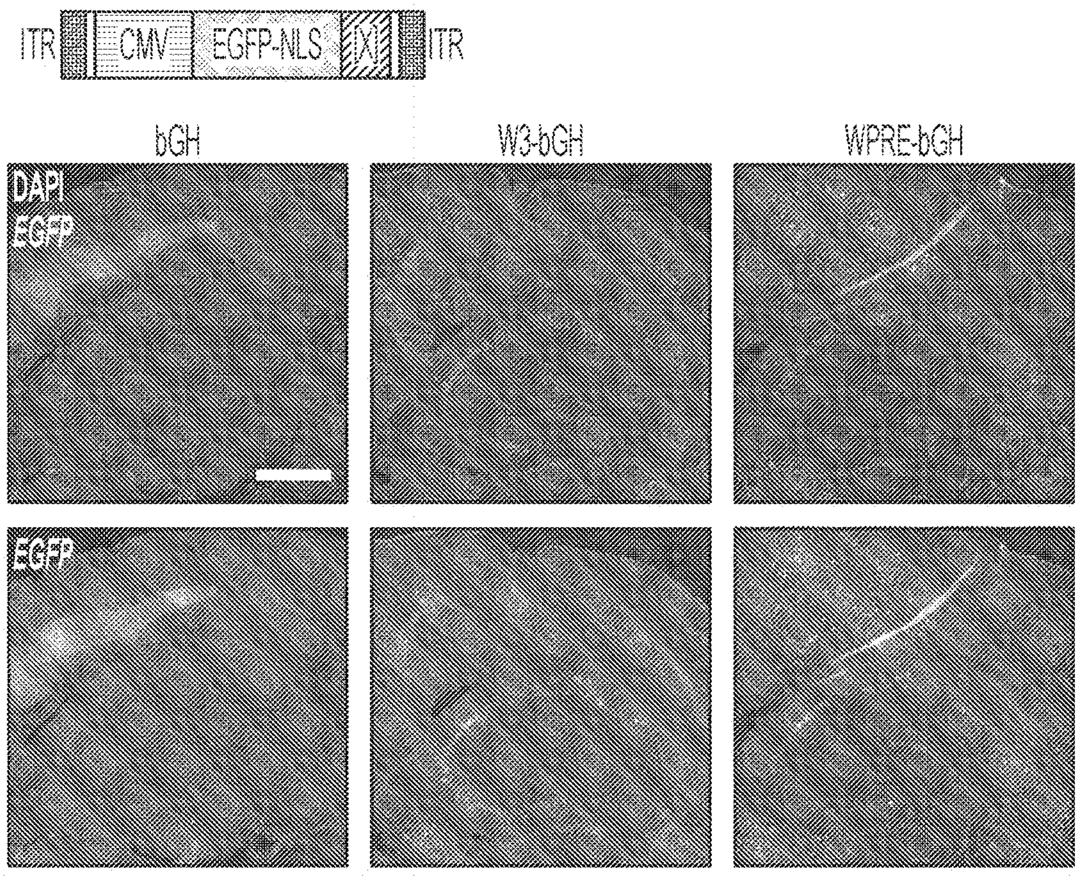
FIGS. 11A-11E show the optimization of split-intein nucleobase editor AAVs.
Figure 11B:
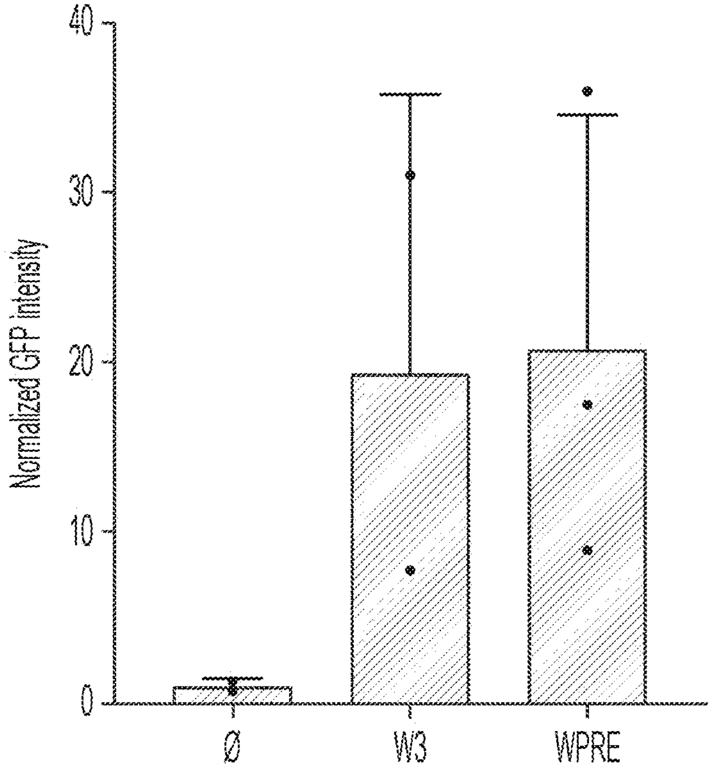
Figure 11C:
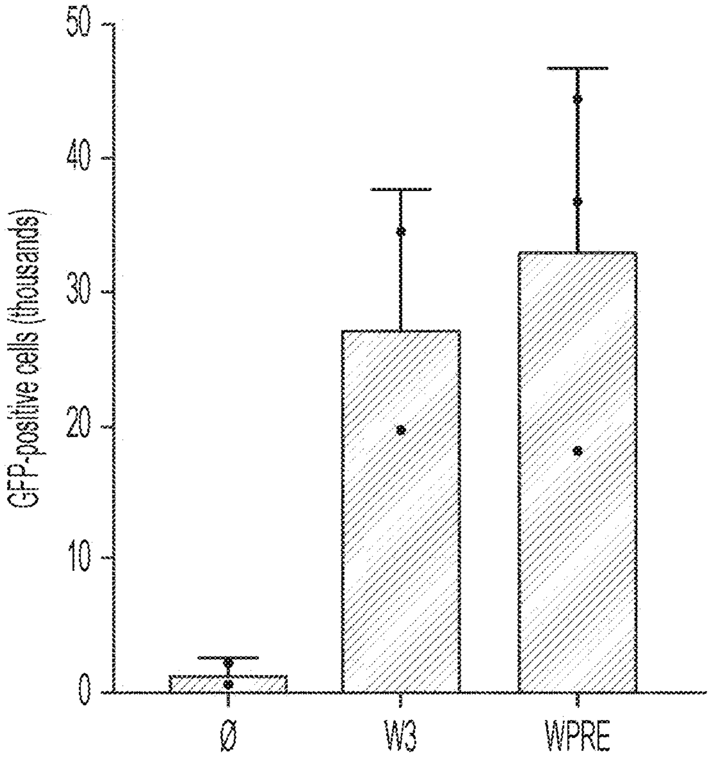

To avoid effects specific to cultured cells, PHP.B[24] was used, which is an evolved AAV variant that efficiently crosses the blood-brain barrier in mice, to test PRE variants in the mouse CNS. $1\times10^{11}$ vg of PHP.B-CMV-eGFP-NLS was delivered into 8-week-old mice by retro-orbital injection, and harvested brain tissue for imaging after a 3-week incubation. W3, a truncated Woodchuck hepatitis virus PRE (WPRE) sequence[25], increased PHP.B-delivered GFP-NLS expression levels in the brain ~19-fold compared to no regulatory sequence (FIGS. 11A-11E). This increase in payload gene expression was comparable to the increase from using the full-length WPRE sequence (20-fold; FIGS. 11A-11C), but W3 is 350 bp smaller than full-length WPRE.

Figure 11D:
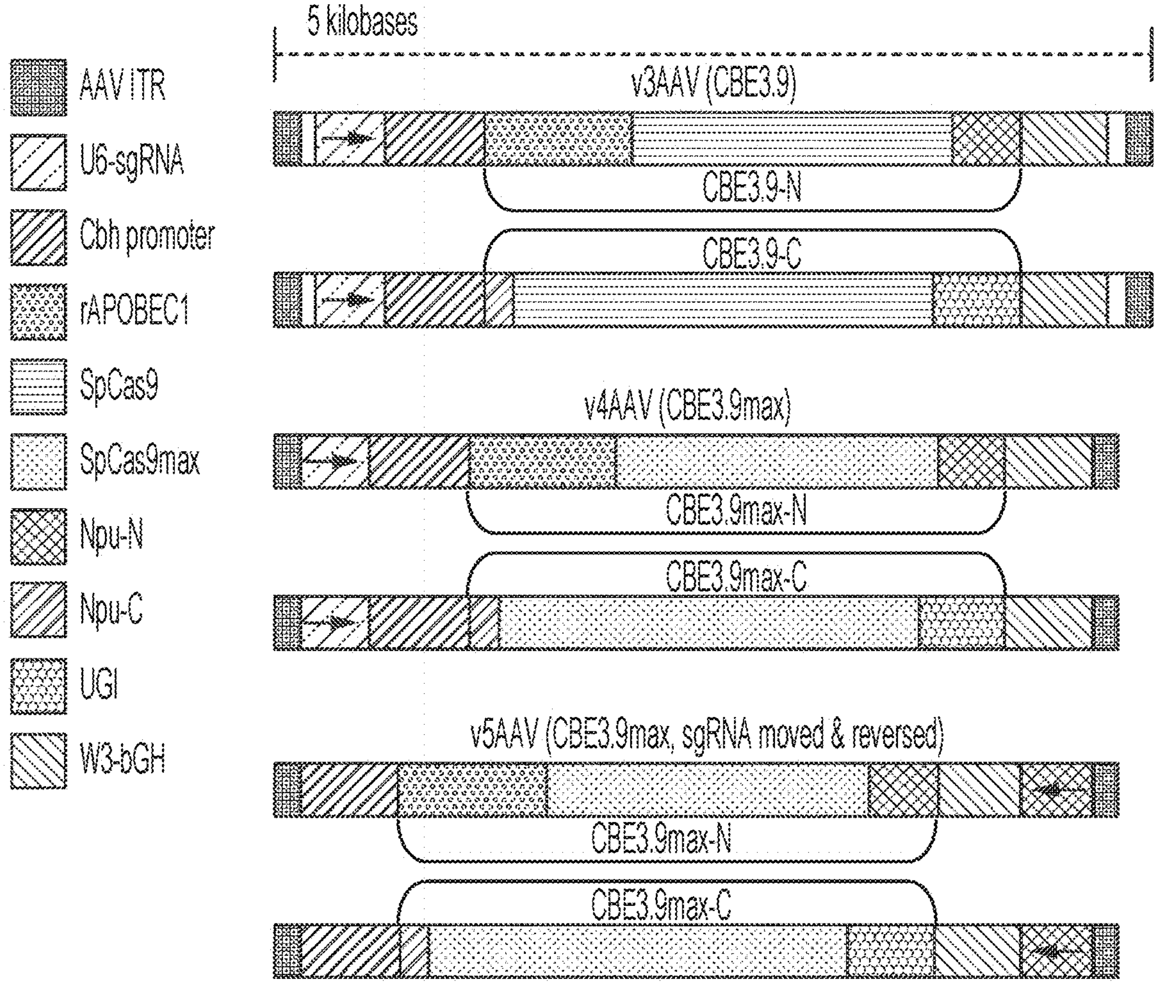
Figure 11E:
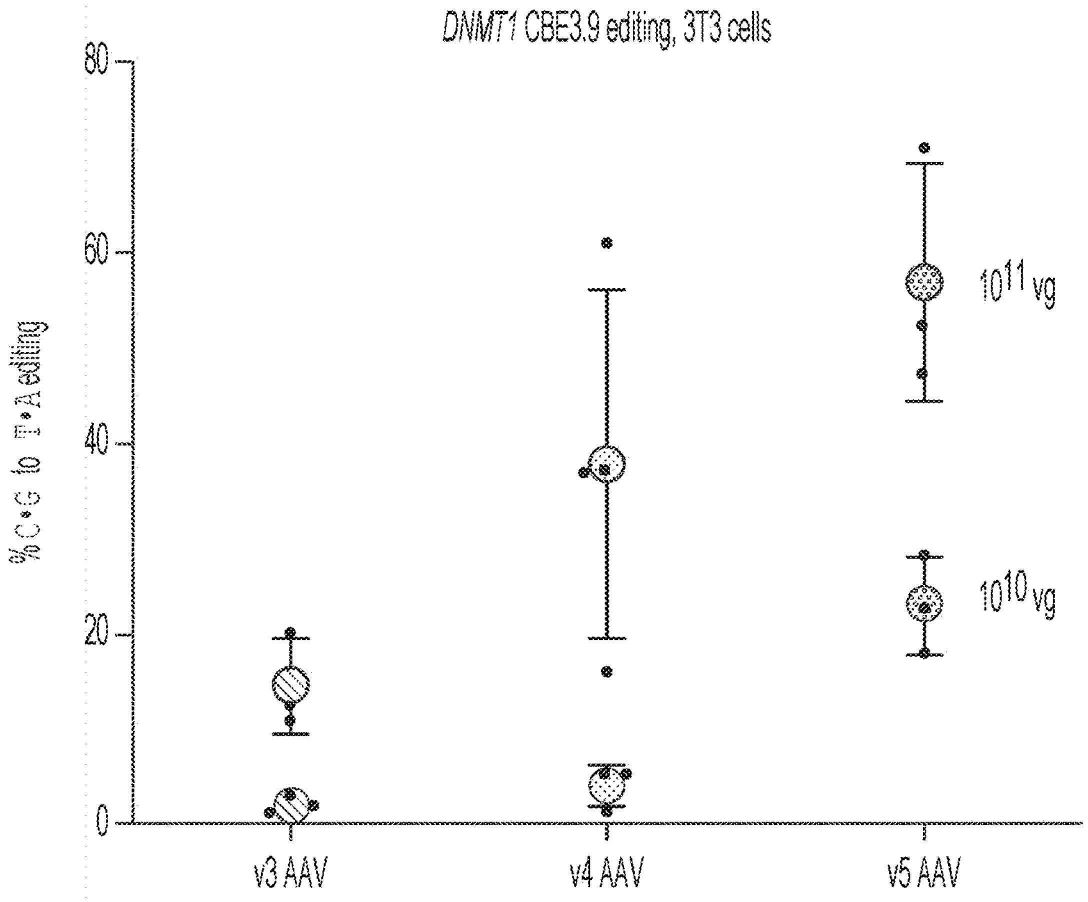

Although the tendency of the CMV promoter to be silenced over time in vivo may be beneficial for some genome editing applications by minimizing off-target editing opportunities[19,26,27], silencing was avoided to maximize editing efficiency in this initial study. The Cbh promoter is a ubiquitous, constitutive promoter that is less sensitive to silencing in vivo than the CMV promoter[28]. Exemplary nucleobase editor AAV constructs therefore contained the W3 sequence, Npu intein, and Cbh promoter, which is referred to hereafter as v3 AAV. To optimize split-base editor AAV configurations, murine 3T3 cells were transduced with dual v3 AAV-PHP.B encoding split-CBE3.9 and a validated sgRNA targeting the mouse DNMT1 locus[29]. DNMT1 acts redundantly with DNMT3a in the mammalian brain[30] and is therefore well-suited for proof-of-concept studies. A dose of $2\times10^{11}$ viral genomes (vg) of v3 AAV per well of 50,000 NIH 3T3 cells, using a 1:1 ratio of the two AAVs, resulted in 14±4.8% C·G-to-T·A editing at the DNMT1 locus. NLS- and codon-optimized CBE3.9max constructs, termed v4 AAV-CBE3.9max, improved C·G-to-T·A editing efficiency to 37±18%, a 2.6-fold increase relative to unoptimized v3 AAV CBE3.9 (FIGS. 11D and 11E).

After optimizing PRE, promoter, NLS, and codon usage, the impact of different guide RNA placements and orientations were tested within the AAV genome. Guide RNA transcription efficiency is known to be sensitive to proximity and orientation relative to AAV ITRs[31]. Moving the U6-sgRNA cassette to the 3' end of the viral genome and reversing its orientation[31], yielding v5 AAV, improved C·G-to-T·A editing efficiency a further 1.5-fold relative to v4 AAV, for a total 3.9-fold total improvement compared to the initial v3 AAV constructs (56±12% for v5 AAV-CBE3.9max versus 14±4.8% for v3 AAV-CBE3.9). These transduction experiments were repeated at a lower virus dose, $2\times10^{10}$ vg per well, and observed 14-fold higher C·G-to-T·A editing efficiency for v5 AAV compared to v3 AAV, and 5.6-fold higher editing for v5 AAV compared to v4 AAV (1.7±0.73% for v3 AAV-CBE3.9, 4.1±2.2% for v4 AAV-CBE3.9max, and 23±5.2% for v5 AAV-CBE3.9max) (FIGS. 11D and 11E). Based on these results, the optimized v5 AAV architecture was used for all subsequent experiments.

Figure 12A:
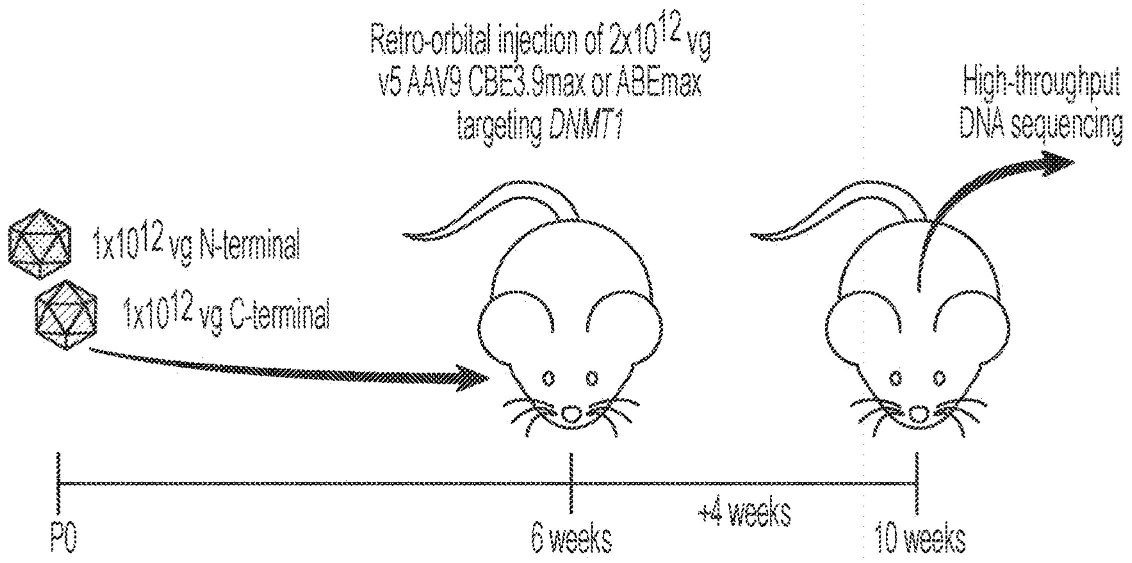
FIGS. 12A-12D show the systemic injection of v5 AAV9 editors results in cytosine and adenine base editing in heart, muscle, and liver.
Figure 12B:
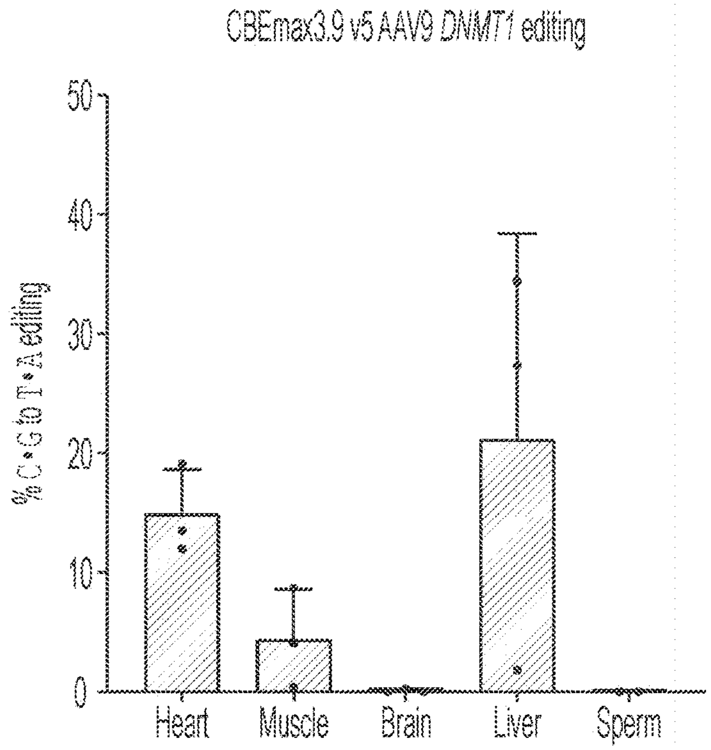
Figure 12C:
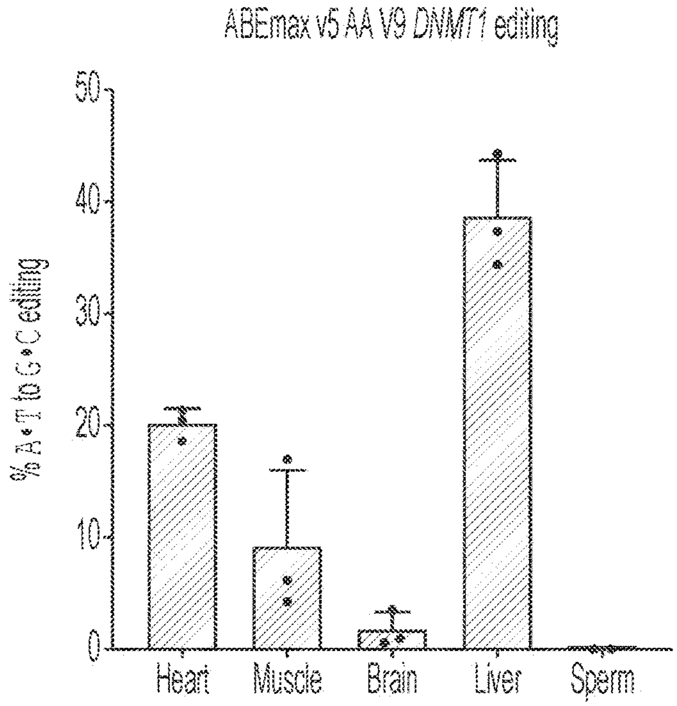
Figure 17:
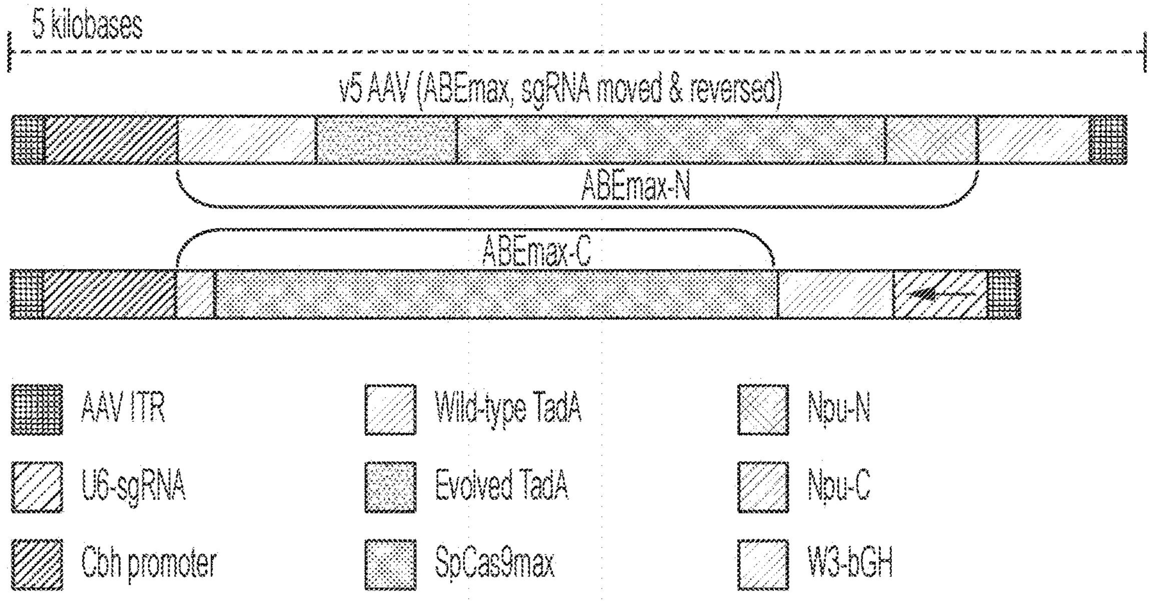
FIG. 17 is a schematic of v5 AAV ABEmax constructs. Arrows indicate direction of U6 promoter transcription. The ABEmax coding sequence consists of wild-type and evolved tadA monomers followed by spCas9 D10A nickase. The U6-sgRNA cassette was omitted from the N-terminal construct to avoid exceeding the AAV packaging limit.
Figure 18A:
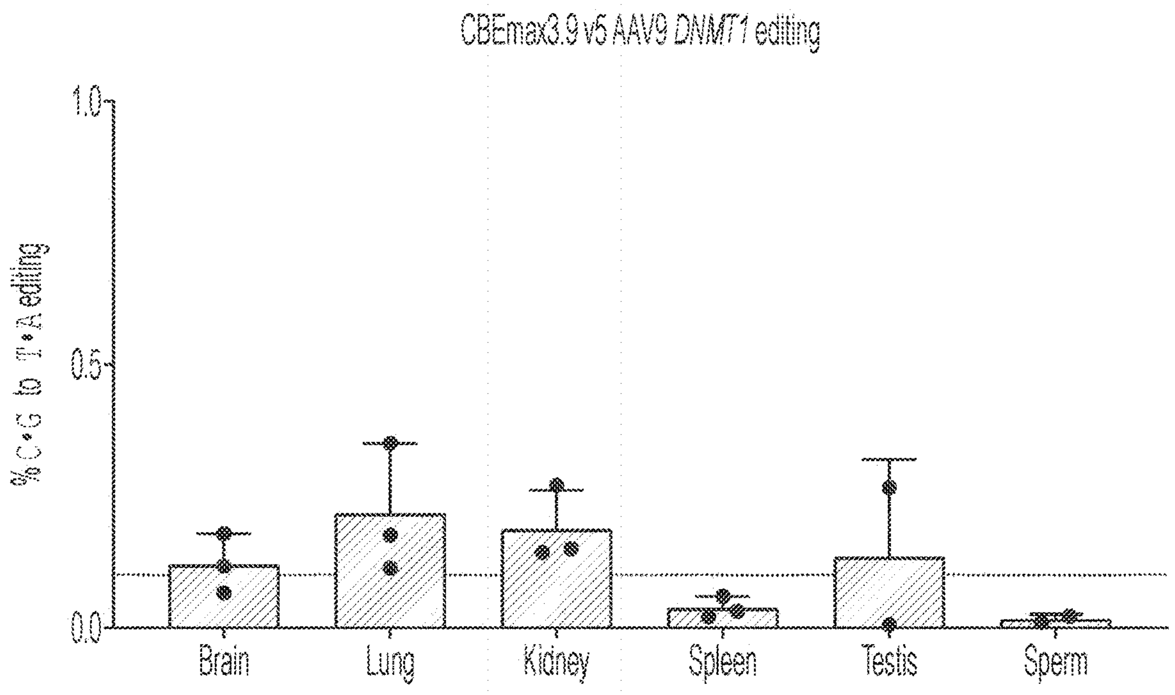
FIGS. 18A-18C show CBE- and ABE-mediated editing in six organs following systemic injection of v5 AAV9 nucleobase editors.
Figure 18B:
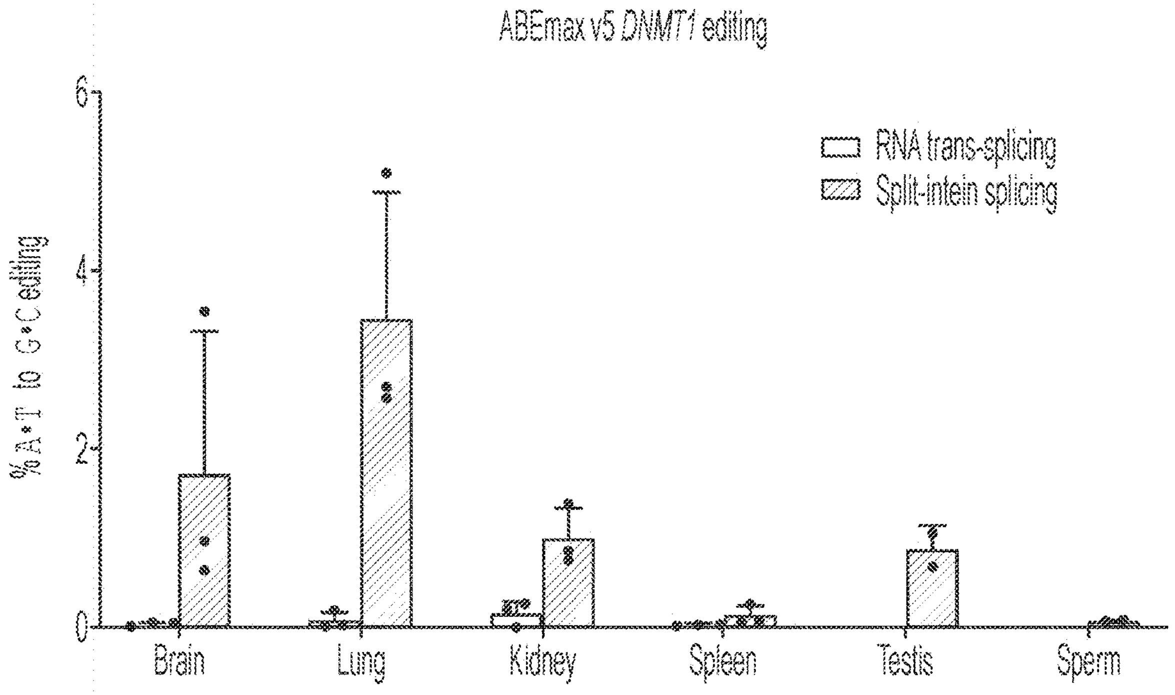
Figure 18C:
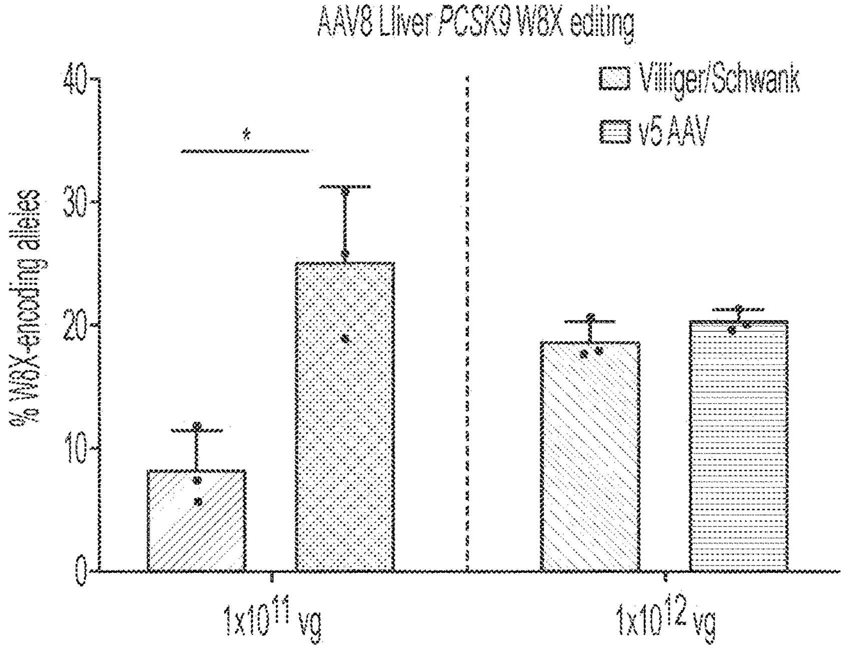

Next the performance of the optimized AAV split-intein nucleobase editor constructs was characterized in vivo. AAV9 is reported to transduce tissues including liver, skeletal muscle, heart, and CNS[32-34]. Dual AAV9 particles were generated in the v5 AAV architecture encoding the optimized split CBE3.9max (FIG. 11D) or ABEmax nucleobase editors (FIG. 17), together with a guide RNA programmed to install a point mutation in DNMT1, resulting in A8T for CBE3.9max, and a silent mutation for ABEmax. Systemic (retro-orbital) injections of v5 AAV9-CBEmax or v5 AAV9-ABEmax were performed in 6- to 9-week-old C57BL/6 mice. Four weeks after injection of $2\times10^{12}$ vg total per mouse, DNMT1 editing was measured in the heart, skeletal muscle, brain, liver, lung, kidney, spleen, and reproductive organs. Following a single dual-AAV injection, both split-intein ABE and CBE v5 AAVs resulted in substantial whole-organ base editing of heart (CBE: 15±3.8% C·G-to-T·A editing efficiency in unsorted cells; ABE: 20±1.4% A·T-to-G·C editing efficiency in unsorted cells) skeletal muscle (CBE: 4.4±2.4%, ABE: 9.2±4.0%), and liver (CBE: 21±17%; ABE: 38±2.9%) (FIGS. 12A and 12B), three organs that are reported to be transduced by AAV9. Consistent with the previously reported intravenous transduction profile of AAV9[35], there was little editing in lung, kidney, spleen, and reproductive organs, and no detectable editing in harvested sperm (FIGS. 18A-18C). Together, these results establish that AAV9 delivery of split-intein CBE and ABE enables efficient in vivo base editing in tissues known to be transduced by AAV9.

Figure 12D:
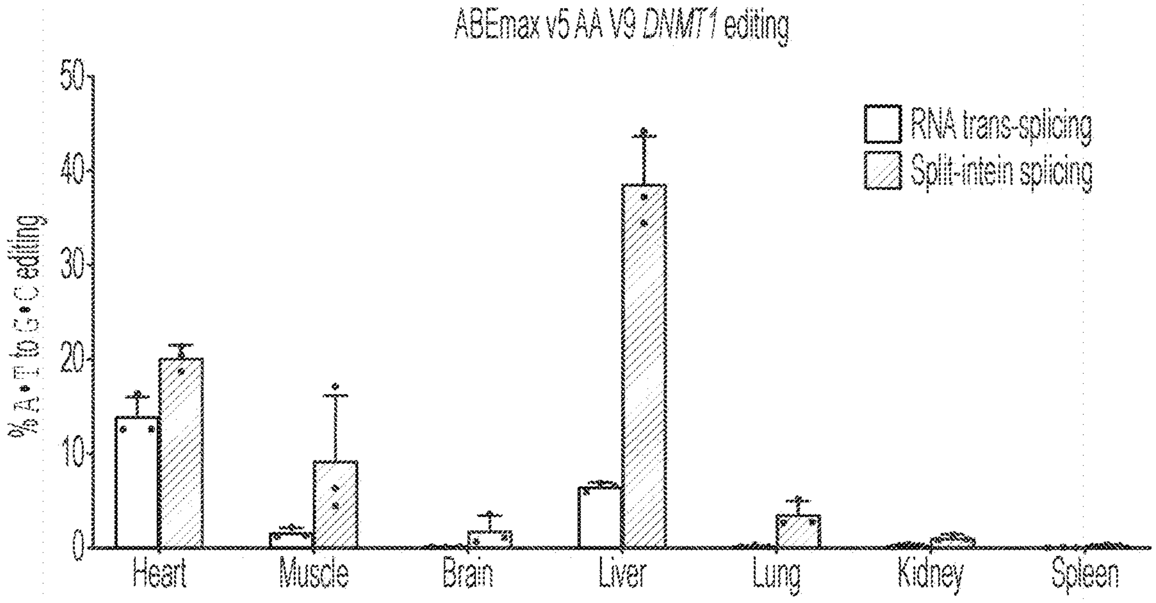

A recent study by Ryu, Kim and coworkers reported AAV-mediated delivery of ABE split by trans-mRNA splicing[8]. The rAAV constructs reported in Ryu et al.[8] were modified to enable direct comparison by replacing the muscle-specific Spc5-12 promoter with the Cbh promoter for ubiquitous expression, and replacing the DMD-targeting sgRNA with the DNMT1-targeting sgRNA. To directly compare the efficiency of AAV-delivered nucleobase editors reconstituted through split intein-mediated splicing, versus trans-mRNA splicing, trans-mRNA splicing constructs were generated with the DNMT1-targeting sgRNA and Cbh promoter. In side-by-side comparisons measuring base editing in three tissues, split intein-spliced v5 AAV ABE on average provided 4.5-fold higher base editing efficiencies than trans-RNA-spliced ABE (FIG. 12D). These results suggest that intein-mediated nucleobase editor protein splicing is more efficient than nucleobase editor mRNA trans-splicing. This efficiency difference may arise from the requirements of AAV genome concatamerization[36] followed by transcription and splicing of the ITR sequences, which have been reported to destabilize pre-mRNA[37], for successful trans-mRNA splicing.

Notably, base editing efficiencies in heart and skeletal muscle from split-intein AAV9 constructs (FIGS. 12A-12D) are comparable to or higher than gene rescue efficiencies reported to improve phenotypes in DMD animal models[38,39], and editing in the liver is above the correction thresholds required for phenotypic improvement in several inborn errors of metabolism[40-42]. These findings suggest that the split-AAV nucleobase editor systems reported here may be suitable for developing treatments to correct animal models of human genetic diseases. It is further noted that these constructs have been optimized for general editing efficiency, and not for application-specific improvements including tissue- or cell type-specific promoters, which could further improve specificity and activity in therapeutically relevant cells. Tissues that are not well-transduced by intravenous AAV9 injections may be transduced by other existing AAV variants, such as AAV4 transduction of the lung[43], or by different delivery routes, such as AAV9 transduction of kidney cells by retrograde ureteral infusion[44].

Recently, Villiger et al. developed an intein-split *S. aureus* CBE (see Villiger, L. et al. *Nature Medicine* 24, 1519-1525 (2018), incorporated herein by reference). To compare those constructs to the v5 constructs described herein, a v5 *S. aureus* CBE using intein-split SaBE3.9max was generated, which has the same NLS- and codon optimizations as the *S. pyogenes* Npu-BE3.9max construct, and was cloned into the v5 AAV architecture. Then, dual AAV genomes in AAV8 were packaged with an sgRNA designed to generate the PCSK9 W8X mutation[31], 3-week-old mice were injected either $1\times10^{11}$ or $1\times10^{12}$ total vg per animal retro-orbitally, and liver tissue was harvested for high-throughput sequencing 4 weeks after injection. The Villiger constructs were modified only by replacement of the liver-specific P3 promoter with Cbh, and the Pah-targeting guide with PCKS9 W8X. At the higher dose, the constructs performed comparably (v5 AAV saCBE: 20±0.9% W8X-encoding alleles; Villiger saCBE: 18±1.6% W8X-encoding alleles). At the lower dose, however, no reduction in editing by the v5 AAV saCBE constructs (25±6.0% W8X alleles) was observed, but a substantial reduction in the editing efficiency of the Villiger constructs (8.2±3.2% W8X alleles) (FIG. 18C) was observed. It was concluded that the higher $1\times10^{12}$ vg dose reaches an editing ceiling due to processes extrinsic to the nucleobase editor, such as host DNA repair processes or cell state-specific factors. At the lower dose of the Villiger constructs, the nucleobase editor itself is limiting. These results demonstrate that the v5 AAV saCBE constructs can outperform the corresponding constructs developed by Villiger.

Base Editing in CNS by Split-Intein CBE and ABE AAV

The above results establish an in vivo CBE and ABE delivery solution for somatic tissues transduced following systemic AAV injection. Delivery to the central nervous system (CNS), however, is especially challenging. Although AAV9 has been reported[45] to cross the blood-brain barrier and transduce CNS cells, minimal editing was observed in the brain following adult retro-orbital injection (FIGS. 12A-12D). To enable in vivo base editing of cells in the CNS, three complementary approaches were explored. First, neonatal cerebroventricular (P0 ICV) injections were performed. Similar to intrathecal injections currently used to deliver nusinersin to treat spinal muscular atrophy (SMA) patients[46], ICV injections are direct injections into cerebrospinal fluid. Second, retro-orbital injections were performed in six-week-old mice using split-intein nucleobase editor AAV based on PHP.eB, a laboratory-evolved AAV9 variant with improved ability to penetrate the blood-brain barrier in C57BL/6 mice[47-49]. Finally, subretinal injections were performed to directly transduce retinal tissue, given that AAV-mediated retinal transduction has already been shown to treat ocular disorders[11].

For all CNS delivery experiments, dual split-intein CBE or ABE v5 AAV targeting DNMT1 were combined together with an AAV encoding a Cbh promoter-driven nuclear membrane-localized GFP-KASH[29] fusion to enable FACS isolation of cells with GFP-positive nuclei. Sorting for GFP-positive cells enriches cell types that are transducible by AAV and that can transcribe genes from the Cbh promoter. This enrichment is especially useful in the CNS, where the heterogeneity of interspersed cell types limits enrichment from physical dissection alone. For example, in the cerebellum, only Purkinje cells, comprising less than 1% of total cerebellar tissue[50,51], are well-transduced by known AAV variants at P0[52,53]. These neurons, however, are critically important as their degeneration causes a number of cerebellar ataxias[54,55]. FACS isolation facilitates quantification of editing in this sparse population, as shown by comparison of editing among sorted and unsorted cell populations (FIGS. 13A-13F).

Figure 13A:
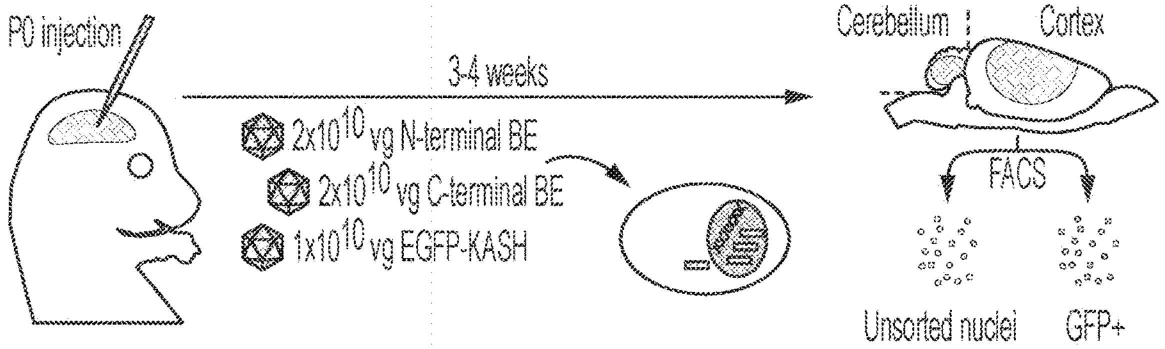
FIGS. 13A-13F show AAV-mediated cytosine and adenine base editing in the central nervous system by two delivery routes.
Figure 13B:
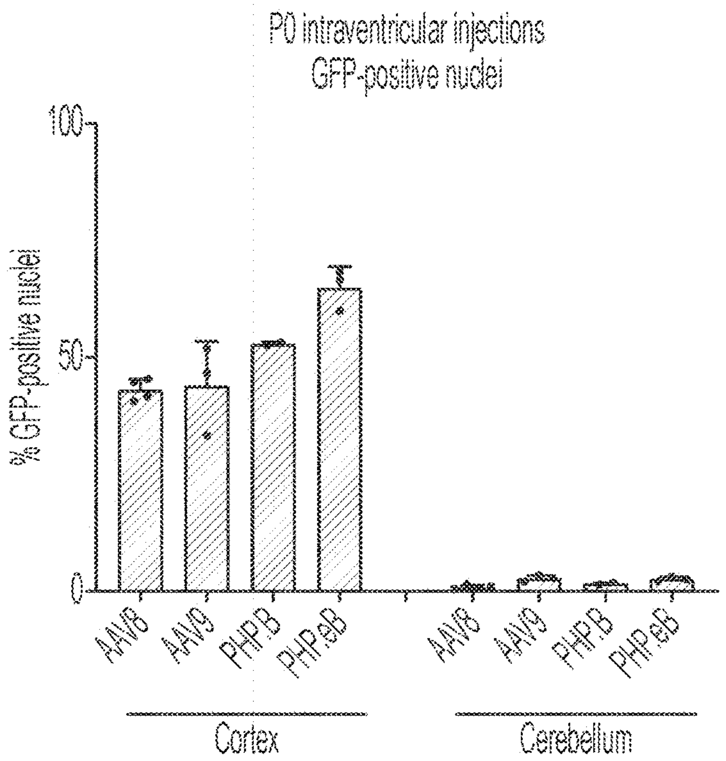
Figure 19A:
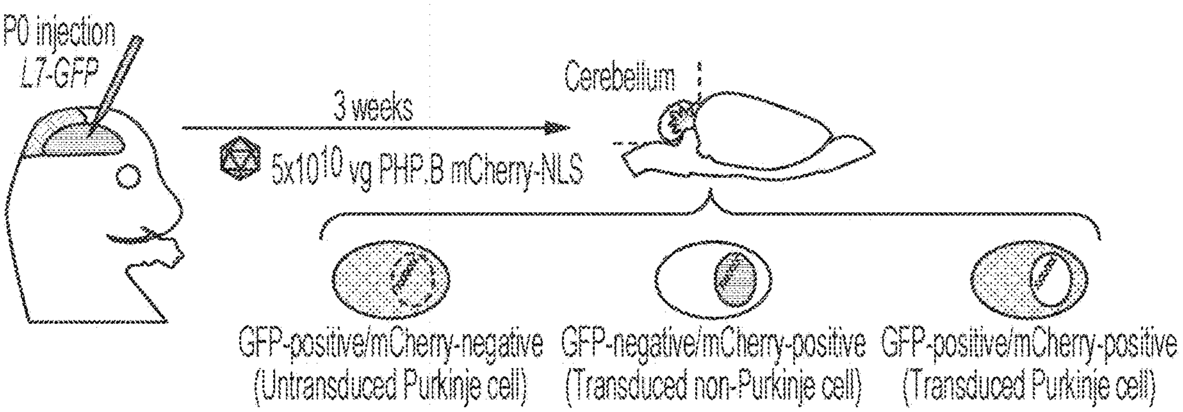
FIGS. 19A-19B show the transduction of cerebellar Purkinje cells by P0 intracerebroventricular injections.
Figure 19B:
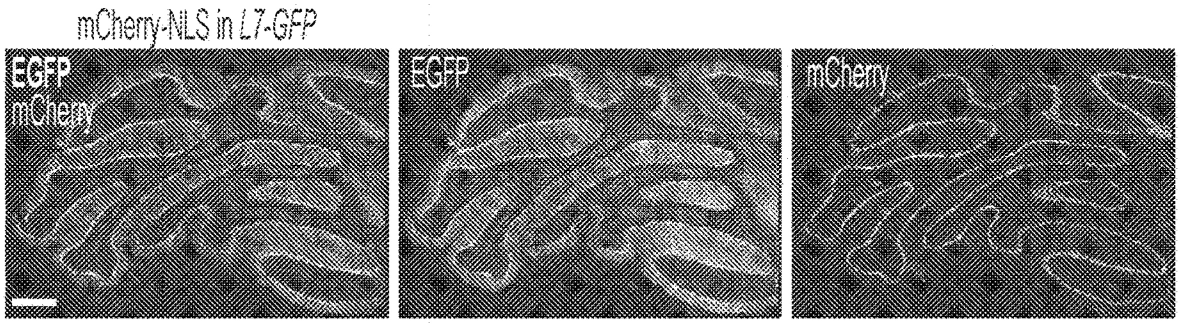

To determine optimal AAV variants for P0 ICV injections, $4\times10^{10}$ vg total of v5 CBE AAV was co-injected with $1\times10^{10}$ vg of KASH-GFP (FIG. 13A). Four AAV variants were tested that were hypothesized to efficiently transduce CNS cells following these neonatal direct brain injections: AAV8 and AAV9, which have both been reported to transduce neurons following P0 injections[52], and laboratory-evolved PHP.B and PHP.eB AAV variants[24,47], which efficiently transduce CNS tissue in older animals. Measurements of GFP-positive nuclei by flow cytometry showed that in cortical tissue, transduction percentages varied from 43±2.2% (AAV8) to 65±4.4% (PHP.eB). In cerebellar tissue, none of the four serotypes efficiently transduced cells (AAV8: 0.8±0.4%; AAV9: 2.7±0.7%; PHP.B: 1.6±0.2%; PHP.eB: 2.5±0.5%) (FIG. 13B). The low transduction in cerebellum is consistent with previous reports that Purkinje cells represent nearly all cerebellar neurons transduced following P0 injections[52,53,56]. To confirm that transduced cerebellar cells were Purkinje neurons, L7-GFP mice, which express cytoplasmic GFP in Purkinje neurons, were injected with an mCherry-expressing AAV9 construct, and observed robust transduction only in GFP-positive cells (FIGS. 19A-19B). Importantly, most Purkinje cells were transduced, suggesting that GFP-positive nuclei reflect a relatively large and unbiased sample of the overall Purkinje cell population. Taken together, these results suggest that all four variants transduce CNS cells with comparable efficiency.

Figure 13C:
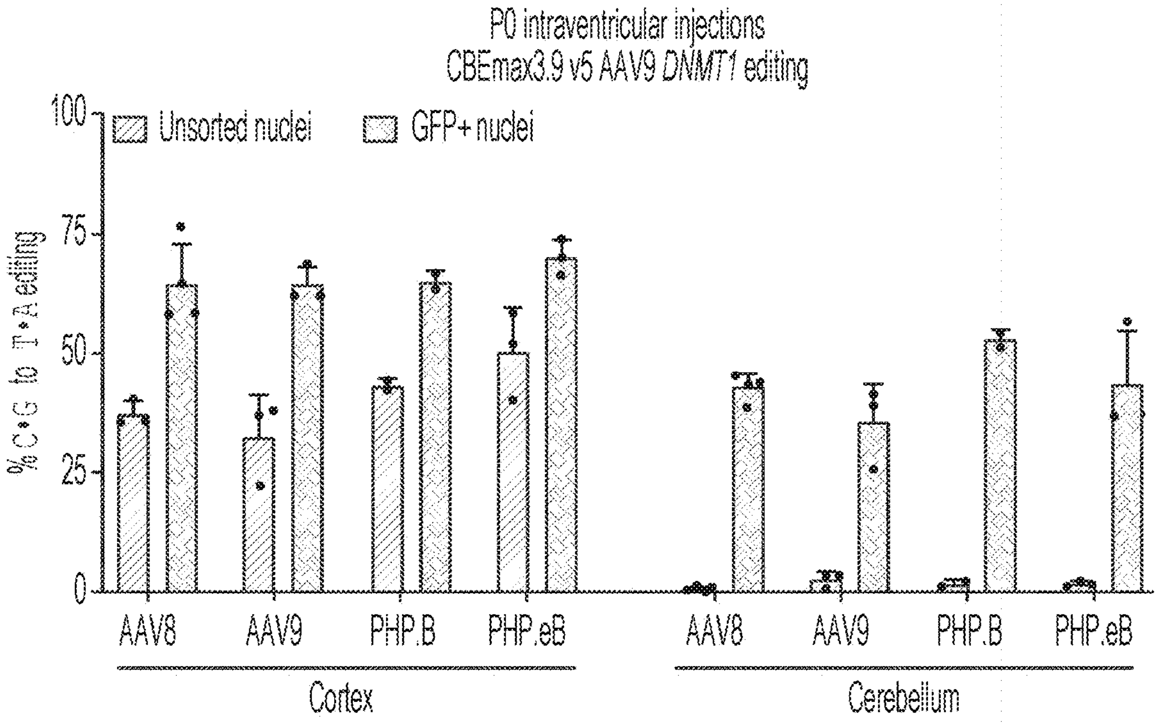

Next, cerebellar and cortical tissue were sequenced. In cortex, it was found that all four tested AAV variants mediated comparable and efficient C·G-to-T·A base editing among GFP-positive cells (65-70% base editing), as well as among unsorted cells (32-50% base editing) (FIG. 13C). In cerebellum, all four AAV variants again resulted in comparable and efficient base editing (FIG. 13C), resulting in 35-52% editing among GFP-positive cells. Since Purkinje cells form the vast majority of transduced cerebellar cells[52,53,56] but represent only a small percentage of cerebellar tissue, base editing in unsorted cerebellar tissue was inefficient as expected, ranging from 0.52% (AAV8) to 2.5% (AAV9).

Figure 13D:
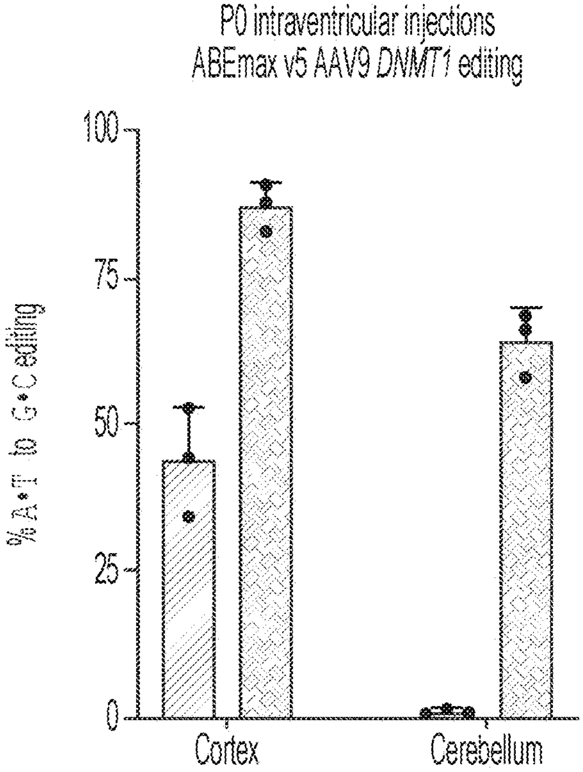

Having demonstrated cytosine base editing in the brain with v5 AAV-CBE3.9max, adenine base editing was tested with v5 AAV-delivered ABEmax. Since all AAV variants tested produced similar CBE3.9max base editing efficiencies, P0 ICV injections of split-intein ABEmax were characterized using only AAV9. It was observed that AAV9-delivered split-intein ABEmax edited cortex with high efficiency (87±4.0% A·T-to-G·C editing among GFP-positive cells; 43±9.1% editing among unsorted cells) and cerebellum (64±5.6% among GFP-positive cells; 1.3±0.5% among unsorted cells, consistent with the small percentage of Purkinje neurons in cerebellum) (FIG. 13D).

Figure 13E:
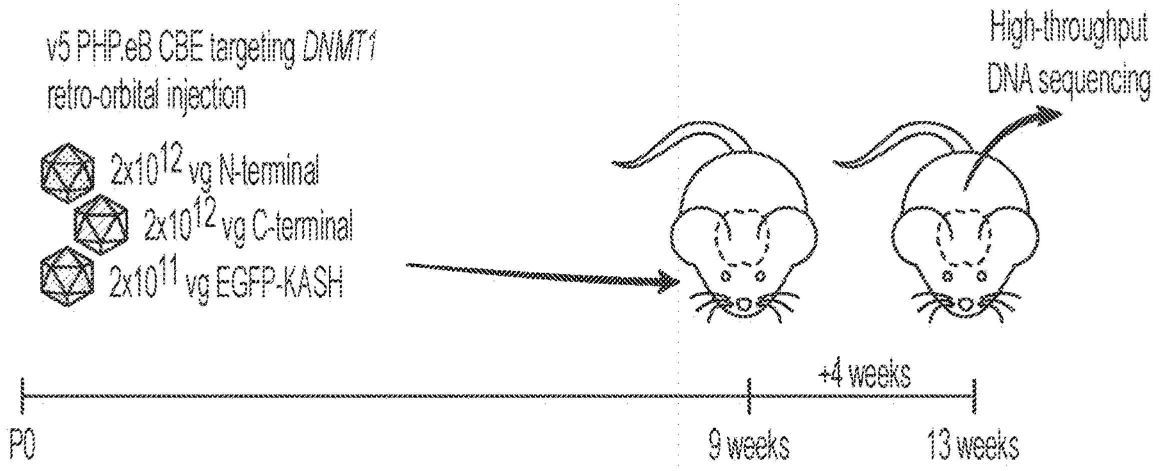
Figure 13F:
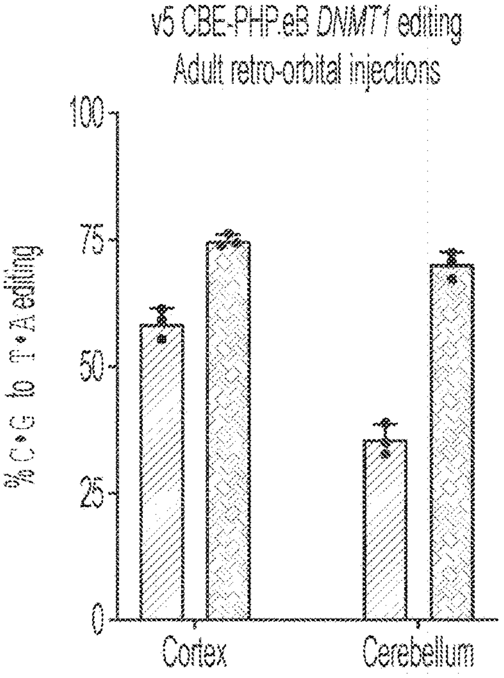

Although direct CNS injections resulted in robust base editing in the brain, it was also sought to determine whether peripheral delivery of AAV via intravenous injection might efficiently edit the CNS, since intravenous injections offer substantial convenience, cost, and safety advantages. $4\times10^{12}$ vg of v5 AAV-PHP.eB encoding CBE3.9max mixed with $2\times10^{11}$ vg GFP-KASH were injected retro-orbitally into nine-week old animals (FIG. 13E). After 3-4 weeks, brain tissue was harvested and sorted. Highly efficient C·G-to-T·A base editing was observed in cortex (74±1.2% among GFP-positive cells, and 59±3.0% among unsorted cells) and cerebellum (70±2.6% among GFP-positive cells, and 35±3.0% among unsorted cells; FIG. 13F). These data indicated that, in contrast to P0 ICV injection, intravenous injection of PHP.eB AAV in adult mice results in robust base editing in unsorted cerebellar tissue, likely due to an increase in the types of cells transduced in adult tissue following expression of AAV receptor proteins. Unlike the restrictive tropism observed at P0, in adult animals PHP.eB transduces several cell types in cerebellum including granule cells and $Olig2^+$ oligodendrocytes[24]. Collectively, these findings establish high-efficiency cytosine and adenine base editing in the central nervous system of a mammal.

In Vivo Base Editing of Retinal Cells

Figure 14A:
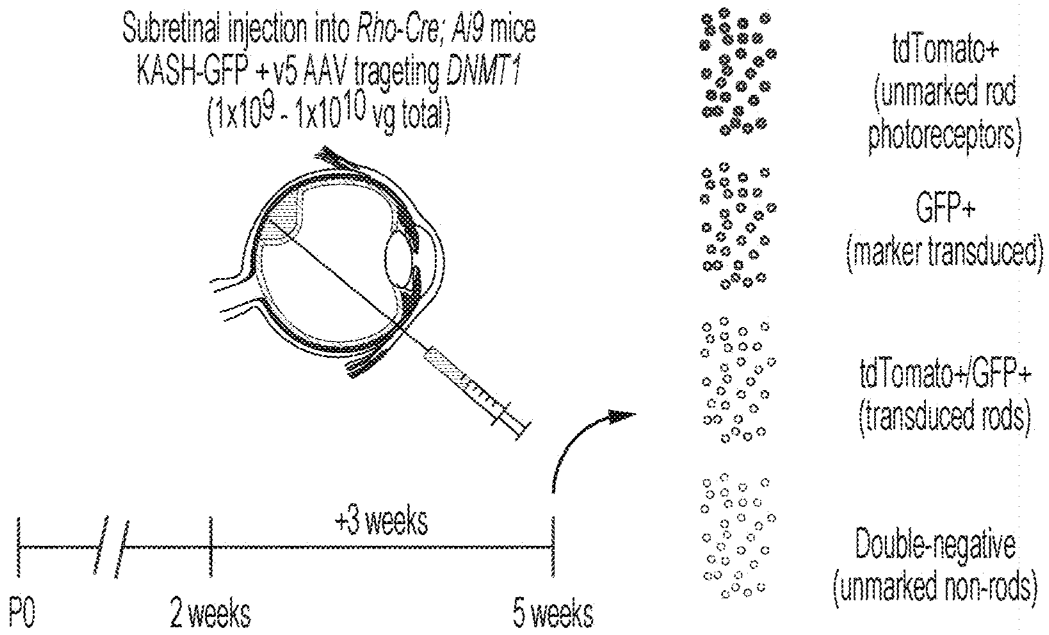
FIGS. 14A-14F show AAV-mediated cytosine and adenine base editing in the retina following sub-retinal injections of 2-week-old Rho-Cre; Ai9 mice.

Genome editing approaches to treating inherited ocular disorders are of special interest given the accessibility of the eye, its immune-privileged status, and the prevalence and impact of congenital blindness. Therefore, the ability of subretinal injections of split-intein ABEmax v5 AAV or split-intein CBE3.9max v5 AAV to efficiently base edit photoreceptors and other retinal cells was tested. Rhodopsin-Cre mice, which express Cre only in retinal rod photoreceptor cells, were bred to Ai9 mice[57] to generate animals that express tdTomato only in rod photoreceptor cells. Subretinal injections of split-intein CBE3.9max or ABEmax dual AAV were performed, targeting DNMT1 in two-week old mice (FIG. 14A). Two AAV variants were tested: PHP.B, as used above for P0 injections, and Anc80, which contains a computationally reconstructed ancestral AAV capsid sequence[58]. PHP.B-Cbh-GFP or Anc80-Cbh-GFP was co-injected as a marker for transduced cells.

Figure 14B:
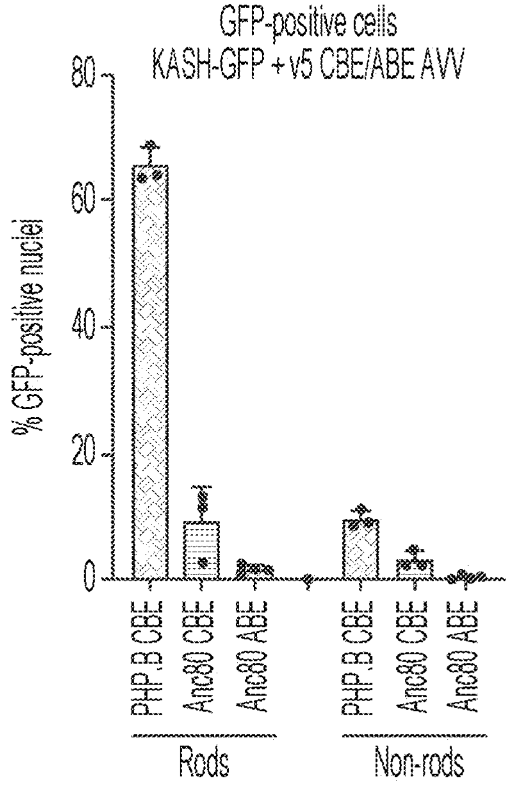
Figure 14C:
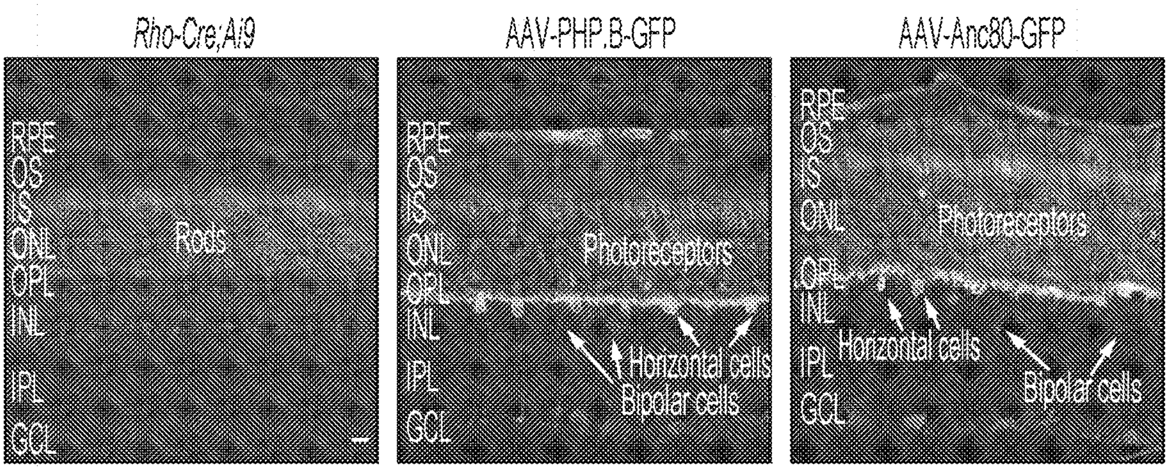
Figure 14D:
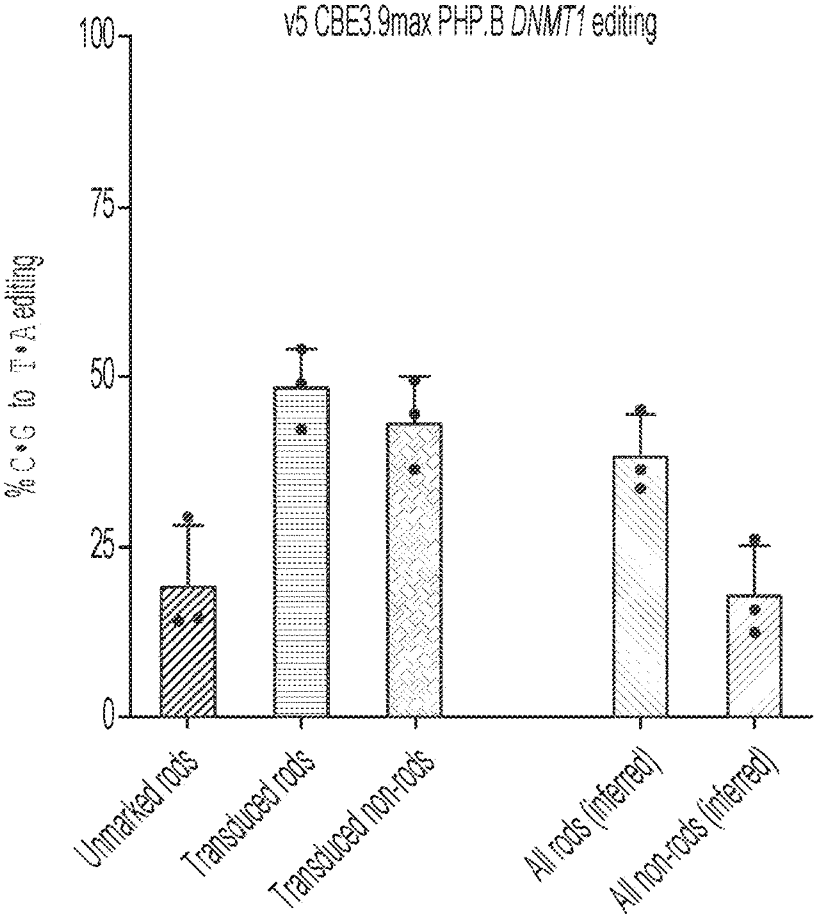
Figure 14E:
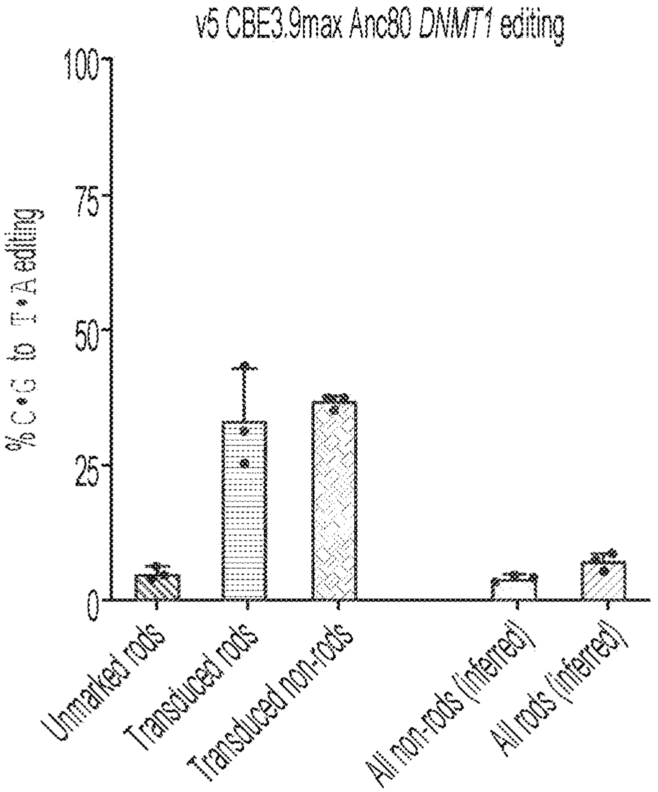
Figure 14F:
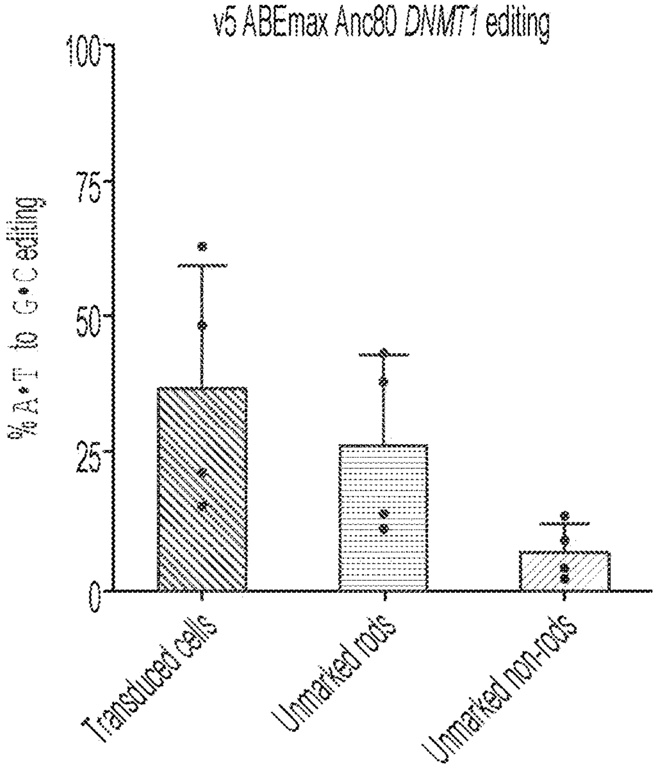

Three weeks post-injection, retinal cells were sorted into GFP+/tdTomato+ (transduced rods), GFP+/tdTomato− (marker transduced non-rods), GFP−/tdTomato+ (unmarked rods), or double-negative (unmarked non-rods) cells. PHP.B-GFP transduced 65±2.8% of rods and 9.6±1.4% of non-rods, while a 6-fold lower dose of Anc80-GFP transduced cells much less efficiently (FIG. 14B). When delivered at the same dose ($5\times10^9$ vg), both PHP.B and Anc80 showed comparable transduction efficiency in the retina, and the majority of cells transduced by both variants were photoreceptors (FIG. 14C). Both PHP.B and Anc80 AAV efficiently delivered split-intein nucleobase editors into retinal cells, with PHP.B-mediated split-intein CBE3.9max resulting in 48±5.9% C·G-to-T·A editing among $GFP^+$/$tdTomato^+$ rod photoreceptors (19±8.7% among all tdTomato-positive rods), and Anc80-mediated split-intein ABEmax resulting in 37±22% A·T-to-G·C editing among $GFR^+$/$tdTomato^+$ rod photoreceptors (26±16% editing among all rod photoreceptor cells) (FIGS. 14D-14F). These editing efficiencies, even among unsorted PHP.B-transduced rod photoreceptors, are similar to the frequencies of wild-type alleles required to improve retinal function in mosaic Pde6b mutant mice[59]. The editing efficiencies observed are also comparable to those reported in preclinical data for EDIT-101, a single-vector AAV treatment for Leber congenital amaurosis that delivers Cas9 nuclease[60], suggesting that dual-vector AAV co-transduction in retinal tissue can achieve therapeutically relevant editing efficiencies.

Figure 20A:
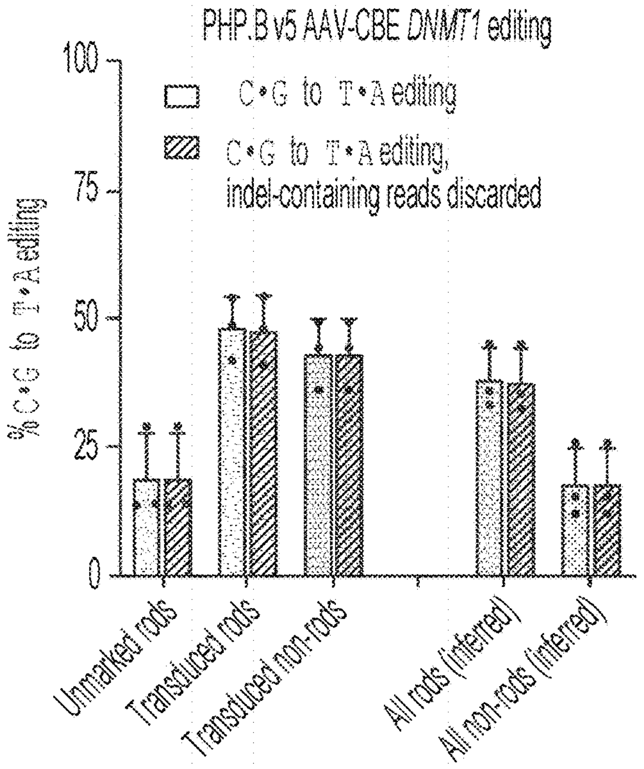
FIGS. 20A-20B show indel-subtracted AAV-mediated cytosine and adenine base editing in the retina following sub-retinal injections of 2-week-old C57BL/6 mice. Indel-containing datasets (solid bars) are reproduced from FIGS. 14D-14E for clarity.
Figure 20B:
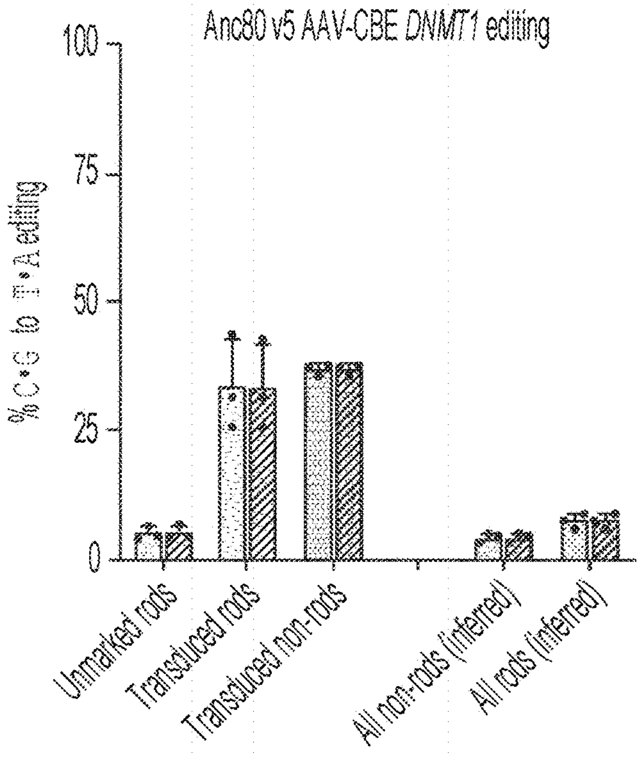

Interestingly, although ABE delivery generated very few indels in retinal cells, consistent with previous results from cultured cells[4], and both ABE and CBE delivery in non-retinal tissues in the experiments described above generally resulted in base edit:indel ratios >10:1 (FIGS. 22A-22C), CBE delivery to retinal cells generated substantial indels, with base edit:indel ratios between 2:1 and 1:1. Despite the substantial frequency of indels, there was little overlap between indel-containing and base-edited alleles. Excluding indel-containing reads did not reduce the number of reads with C·G-to-T·A editing (FIGS. 20A-20B), indicating that base edited alleles in general do not contain indels. These observations suggest that CBE-mediated indels in retinal cells occur through uracil excision pathways that are mutually exclusive with pathways that lead to cytosine base editing outcomes, or that base edited or indel-containing products are poor substrates for subsequent indel-generating or base editing processes, respectively.

In Vivo Correction of a Causal Niemann-Pick Mutation in Mouse CNS

Integrating the above developments, AAV-mediated in vivo nucleobase editor delivery was applied to correct a mutation associated with human disease in the CNS of an animal. NPC1 mediates intracellular lipid transport, and loss-of-function mutations cause Niemann-Pick type C (NPC) disease, a neurodegenerative ataxia. NPC1 c.3182T>C (encoding Ile1061Thr) is the most prevalent mutation in humans that causes NPC1 disease[61,62]. Previous work suggests that Niemann-Pick disease is primarily a CNS disorder; genetic deletion of NPC1 in the CNS alone causes Niemann-Pick disease in mice[63], while expression of wild-type NPC1 in the CNS alone prevents the disease[64,65]. Furthermore, deletion of NPC1 in Purkinje cells alone causes motor impairment[66]. Chimeric studies suggest that the death of Purkinje neurons is cell-autonomous and therefore amenable to mosaic rescue[67]. $NPC1^{I1061T}$ homozygous mice develop ataxia and have a reduced lifespan of approximately 17 weeks[62].

Figure 15A:
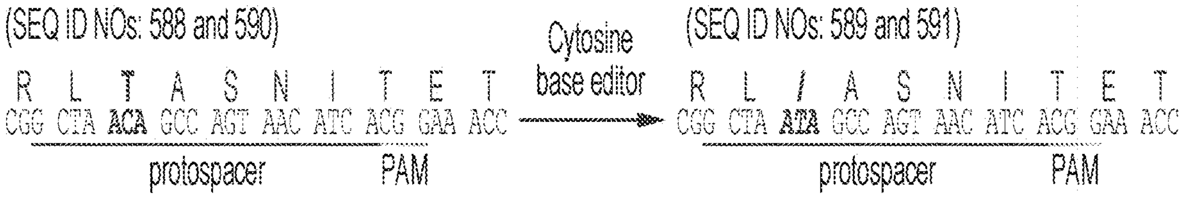
FIGS. 15A-15H show base editing of $NPC1^{I1061T}$ in the mouse CNS.
Figure 15B:
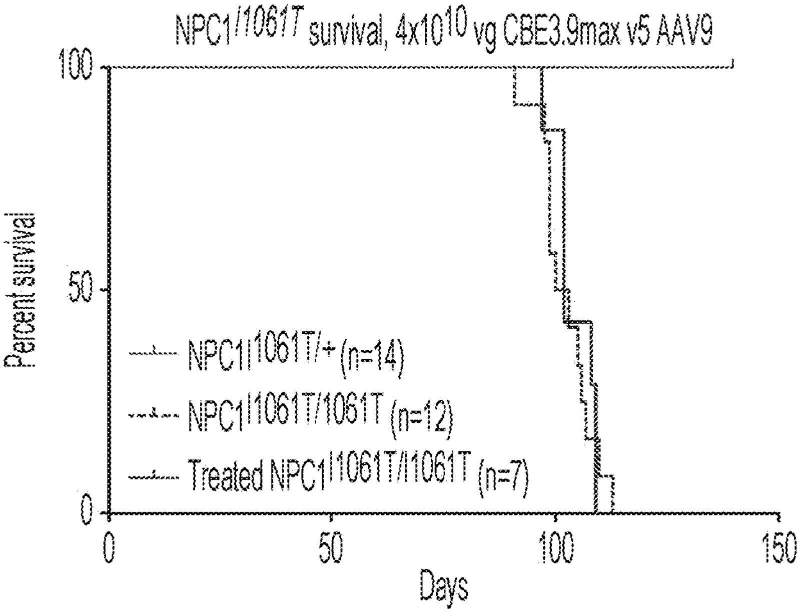
Figure 15C:
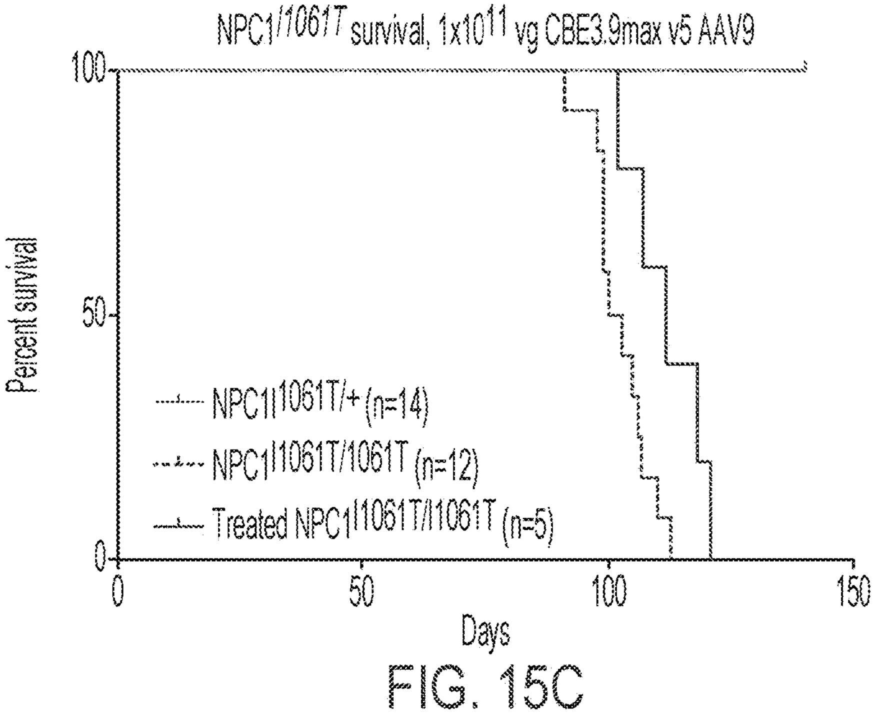

To test if base editing of $NPC1^{I1061T}$ in the CNS might extend lifespan, P0 $NPC1^{I1061}$T (c.3182T>C) homozygous mice were injected with $4\times10^{10}$ or $1\times10^{11}$ vg total CBE3.9max v5 AAV9 ($2\times10^{10}$ or $5\times10^{10}$ vg of each AAV half) targeting the $NPC1^{I1061T}$ mutation and $1\times10^{10}$ vg of KASH-GFP, which are referred to as low dose and medium dose, respectively. Base editing at this site should directly reverse the I1061T mutation back to wild-type NPC1 (FIG. 15A). Although no difference was found in lifespan between low-dose and untreated animals (FIG. 15B), medium-dose animals survived significantly longer than untreated animals (FIG. 15C, 12% longer median lifespan; $\chi^2=4.631$, df=1, p=0.031 by Mantel-Cox test). Animals were euthanized at the onset of morbidity to harvest brain tissue for high-throughput DNA sequencing, and GFP-positive cortical and cerebellar nuclei were sorted as described above (FIGS. 13A-13F).

Figure 15D:
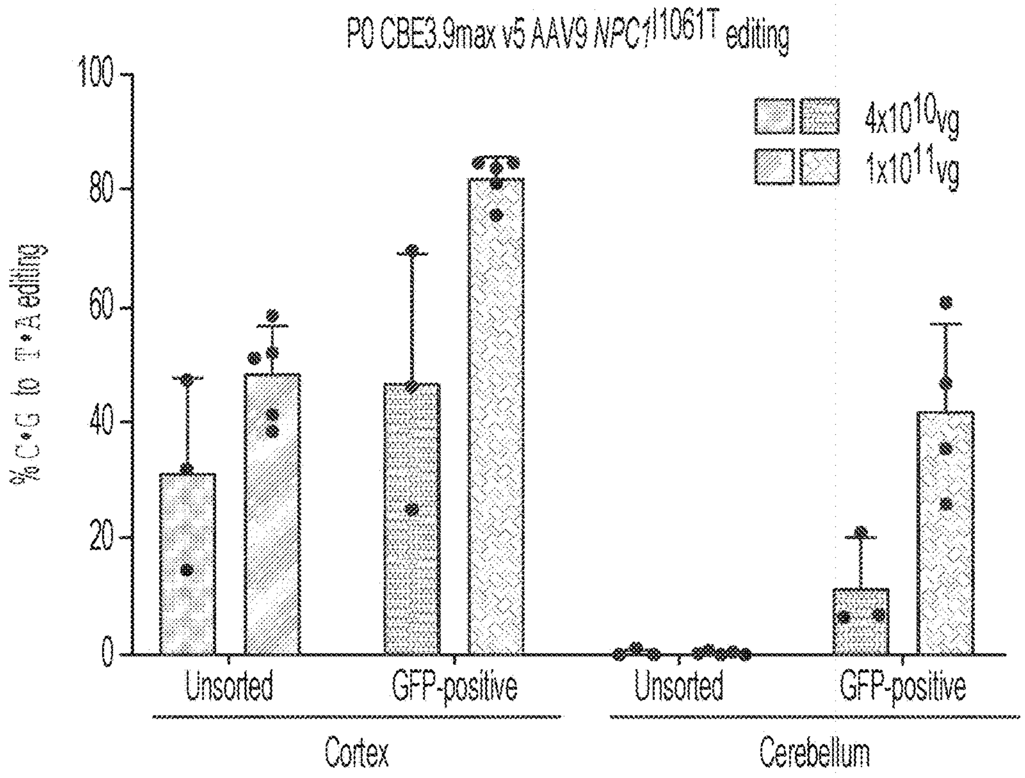
Figure 15E:
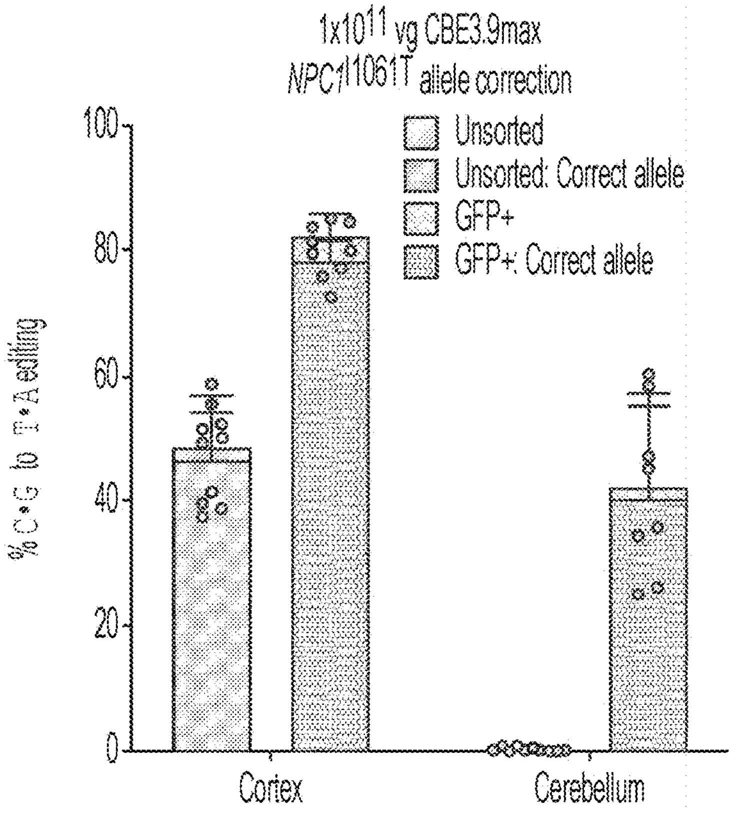
Figure 15F:
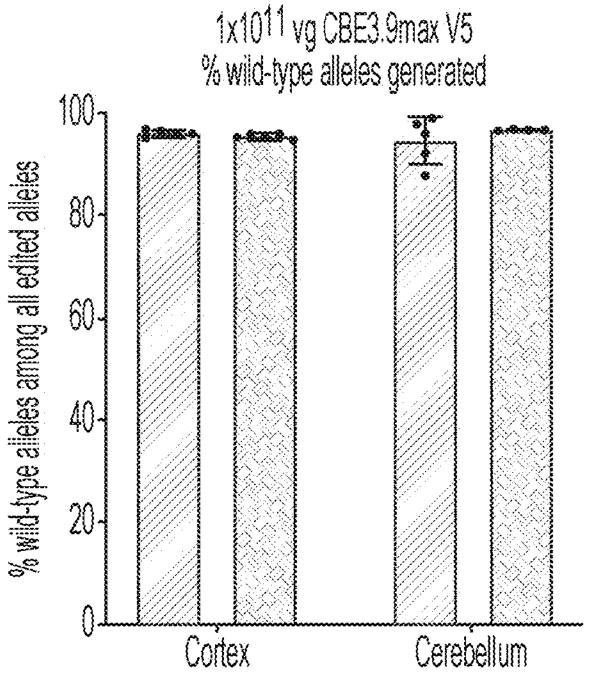
Figure 15G:
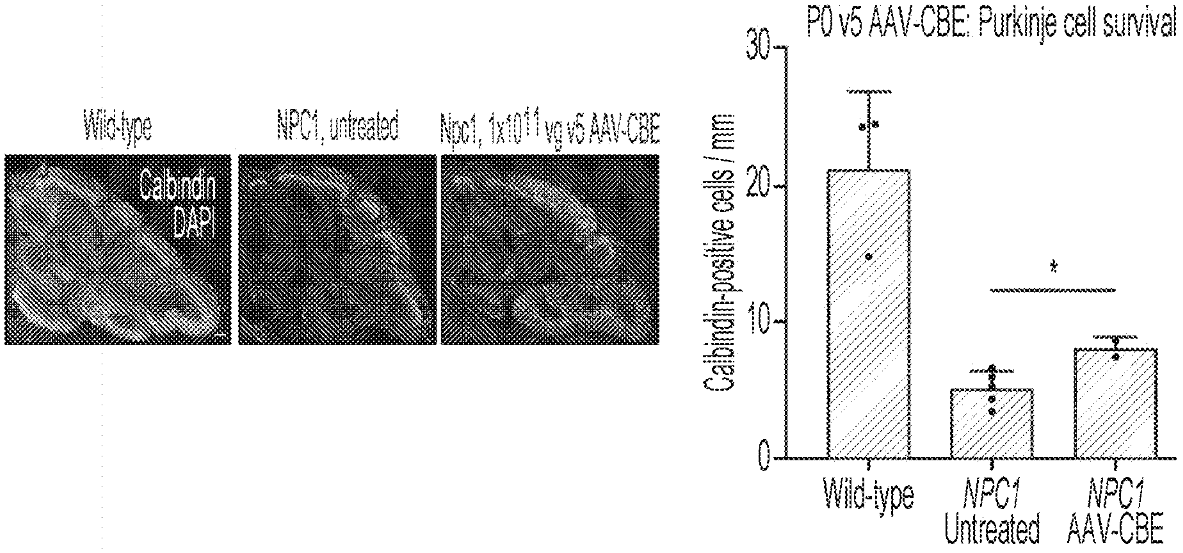
Figure 15H:
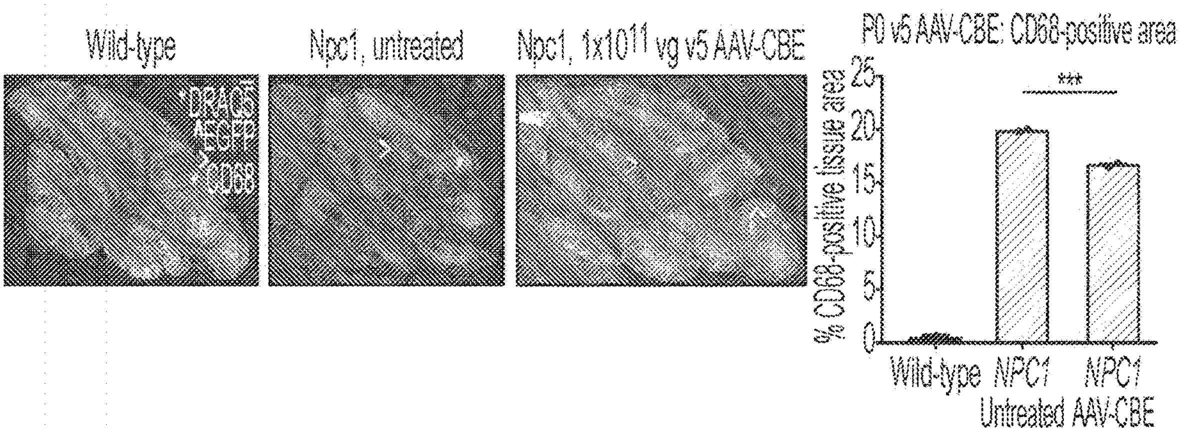
Figure 16A:
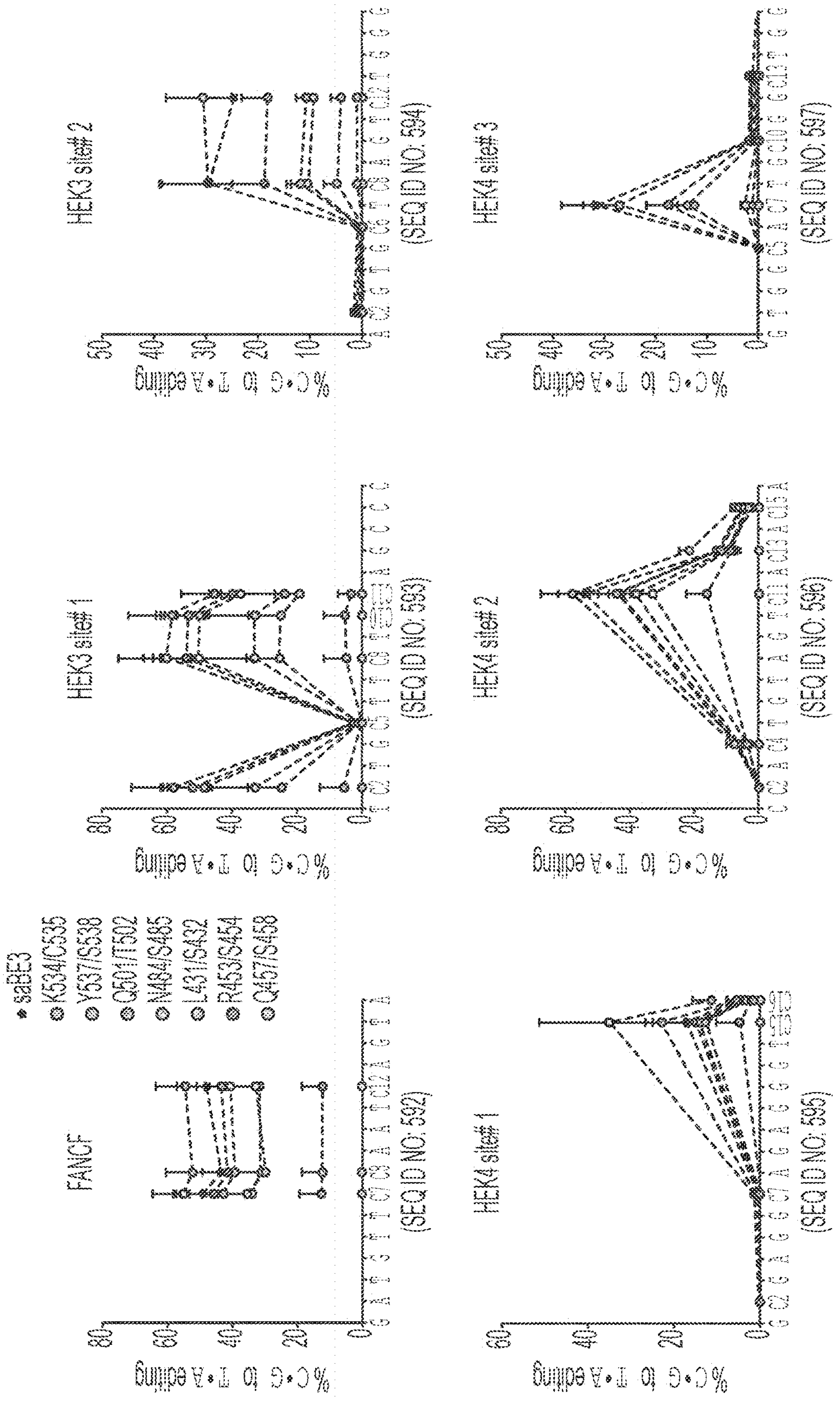
FIGS. 16A-16F show the development of a split-intein *S. aureus* CBEs.
Figure 16B:
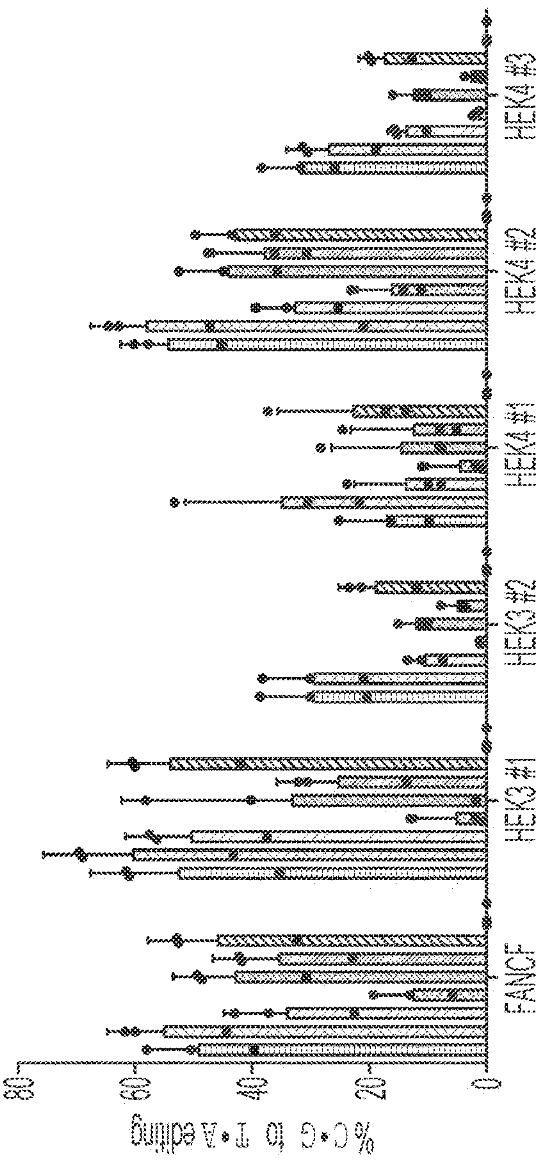
Figure 16C:
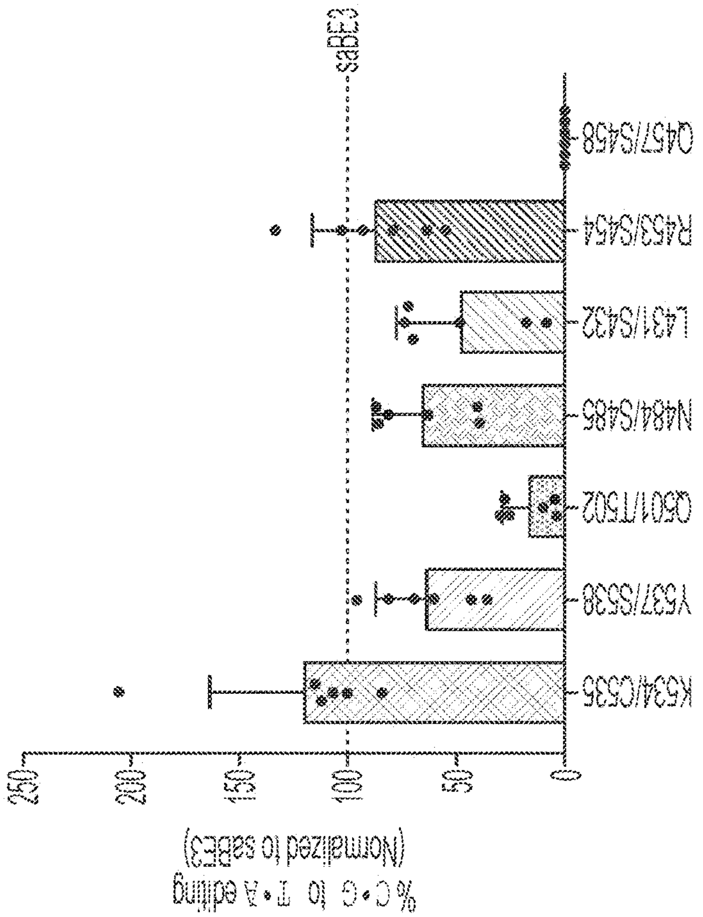
Figure 16D:
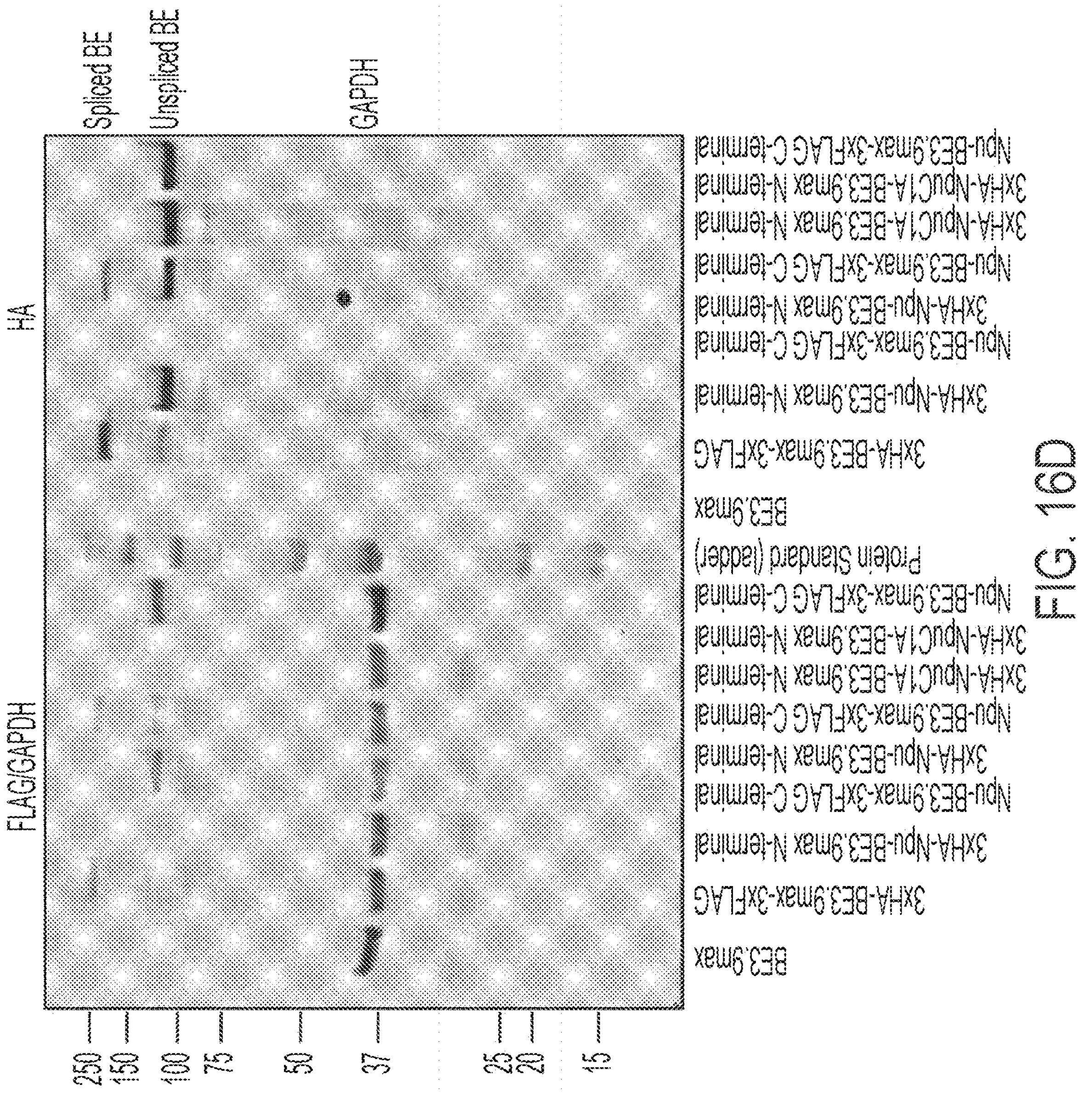
Figure 16E:
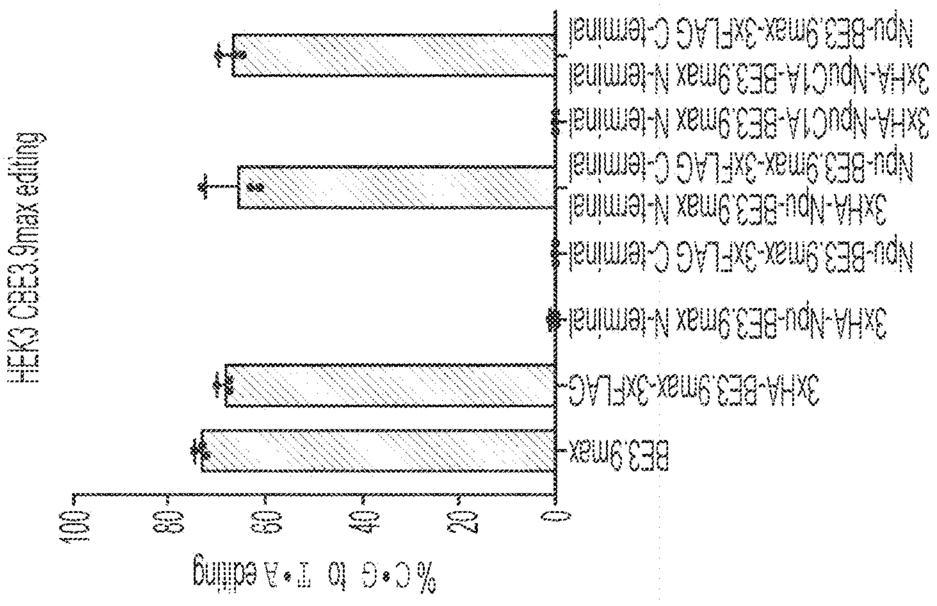
Figure 16F:
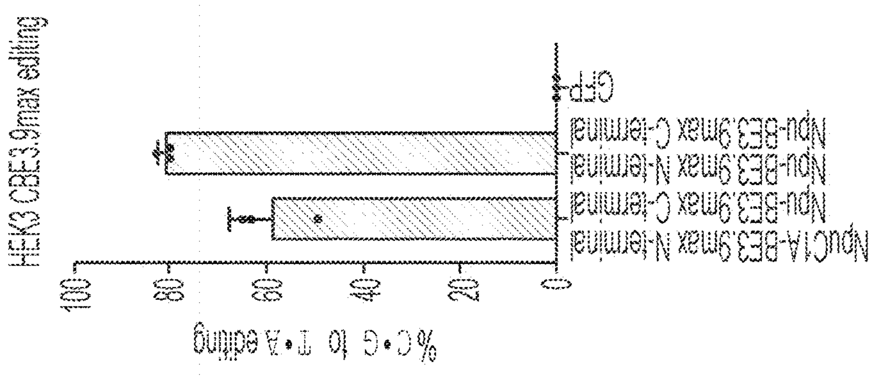
Figure 28A:
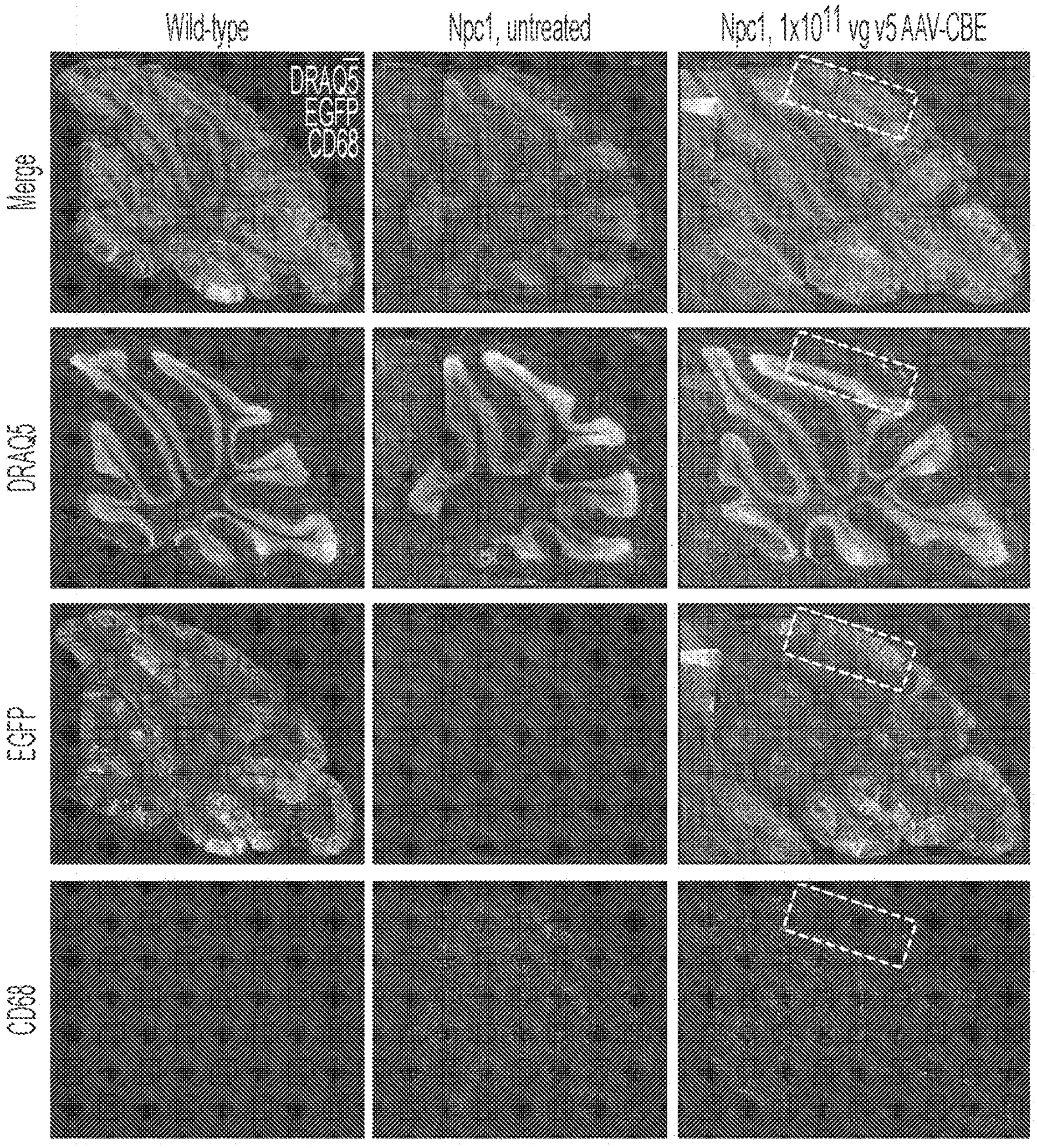
FIGS. 28A-28B show cerebellar CD68 staining.
Figure 28B:
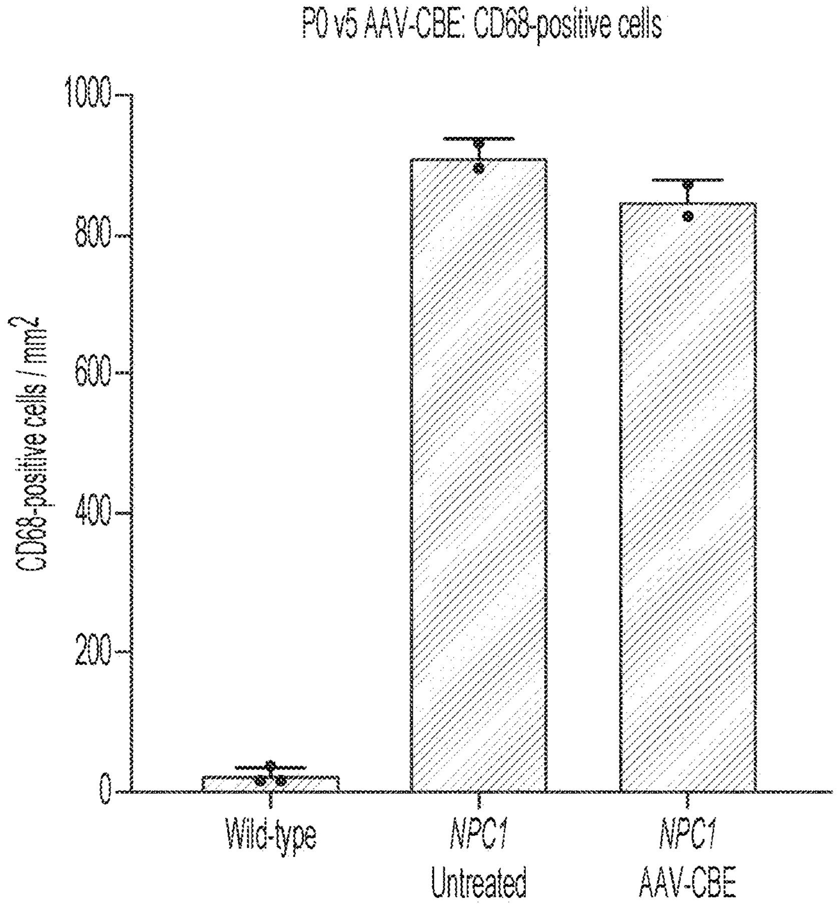
Figure 29A:
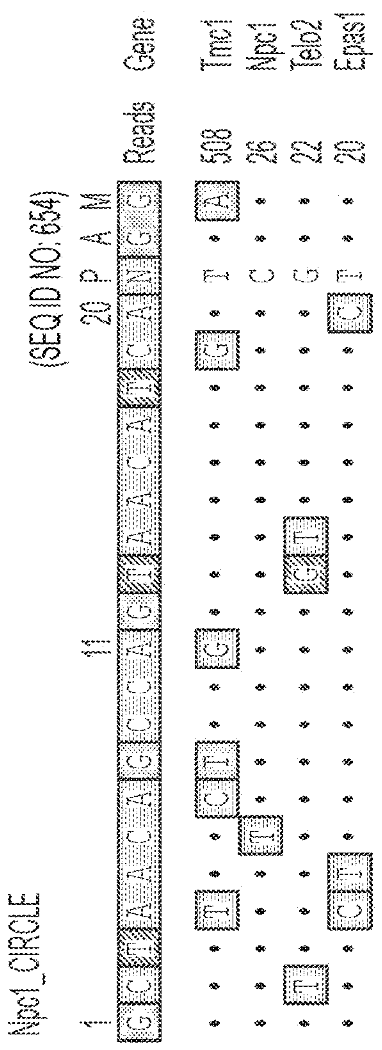
Figure 29C:
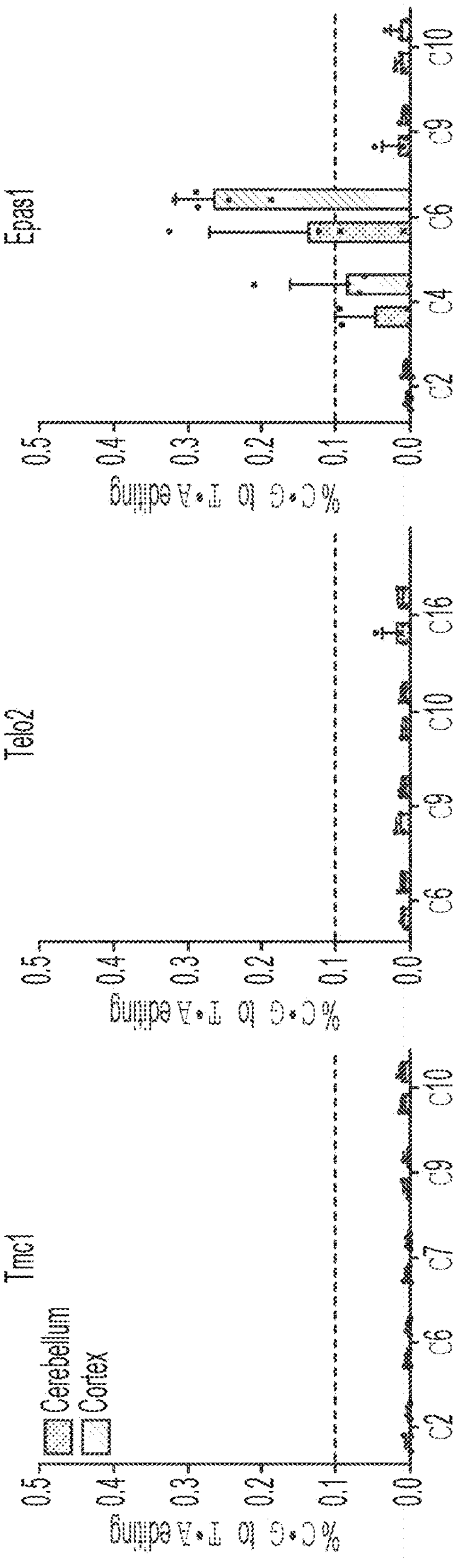
Figure 29D:
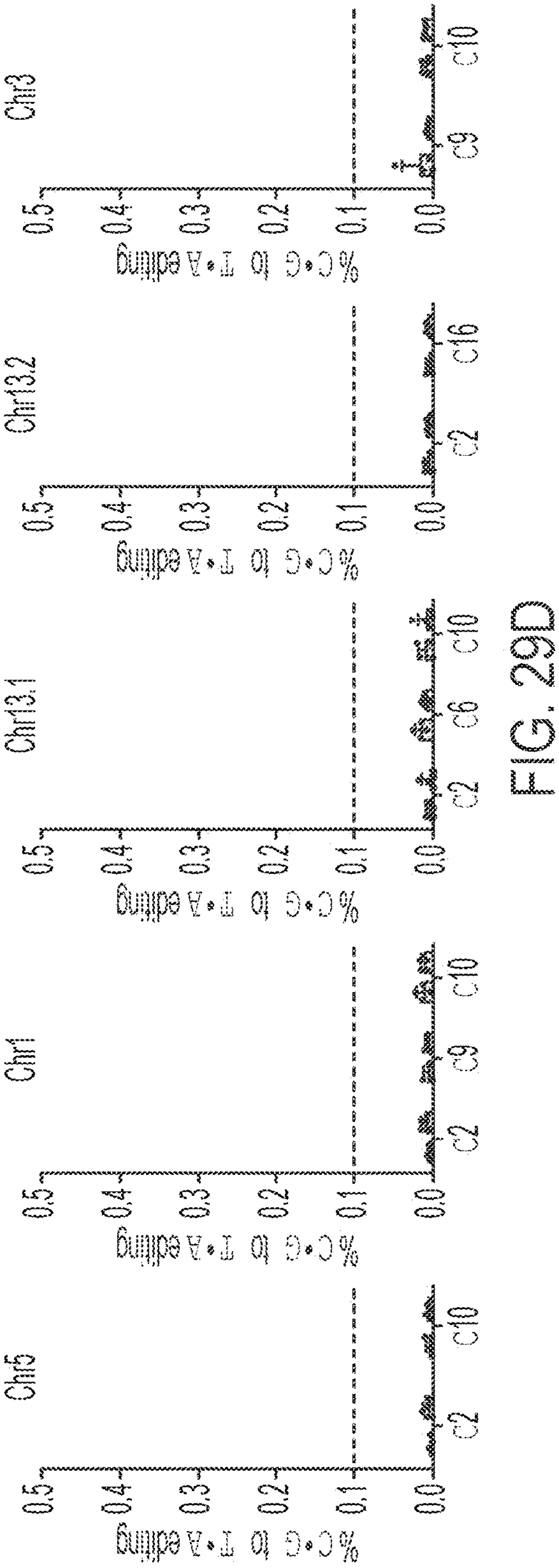

To determine if v5 AAV9-CBE injection increases the number of surviving Purkinje neurons, a cohort of age-matched injected and untreated mice were compared at P98-P105, close to the lifespan of the untreated mice. In agreement with the observed lifespan extension, injection of AAV9 AAV-CBE increases the number of surviving Purkinje neurons, from 24% of wild-type to 38% of wild-type (uninjected, 5.1±1.2 Purkinje neurons per mm of Purkinje cell layer; injected, 8.0±0.8 PCs/mm; wild-type, 21.1±5.5 PCs/mm; uninjected vs. injected, p=0.03) (FIG. 15G). Quantitatively similar increases in Purkinje cell survival mediated by small molecules in $NPC1^{-/-}$ mice have previously been associated with lifespan increases similar to those that were observed[80]. These results demonstrate that AAV-mediated CNS base editing of NPC1 increases the survival of Purkinje neurons to an extent consistent with the lifespan increase of the treated mice. To further probe the possibility that NPC1 base editing improves cellular markers of NPC1 disease and to determine whether the CBE-mediated mosaic rescue might provide systemic benefits, CD68+ reactive microglia, a measure of CNS inflammation[65,81] were examined. The density of CD68+ cells and total $CD68^+$ tissue area in mice injected with AAV9 AAV-CBE was quantified, finding modest decreases in $CD68^+$ tissue area in agreement with the modest increase in Purkinje cell survival (FIG. 15H, decrease from 19.9±0.05% to 16.7±0.08%; p=0.005. Single-channel images included in FIG. 28A). Although CD68+ cell density decreased from 913±26 to 850±30 cells/$mm^2$, this difference was not statistically significant (FIG. 28B, p=0.15).

In animals given a low dose of v5 AAV, the $NPC1^{I1061T}$ mutation was corrected with 31±16% efficiency in unsorted cortical nuclei, and in 46±22% of GFP-positive nuclei. In cerebellum, editing of 0.4±0.5% was observed in unsorted tissue, and 11±8.4% in GFP-positive nuclei, which correspond to the critical Purkinje neuron population that must be edited to treat NPC1 disease. In medium-dose animals, cortical editing of 48±8.2% and 81±3.7% was observed in unsorted and sorted nuclei, respectively, and cerebellar editing of 0.3±0.2% and 42±14% of unsorted and sorted nuclei, respectively (FIG. 15D). In all cases, C-to-T editing without bystander edits or indels was predominant among edited alleles; over 94% of edited alleles cleanly correct the I1061T mutation and encode the wild-type allele (FIGS. 15E and 15F).

It was also determined whether off-target editing might occur in the sorted cerebellar and cortical nuclei. Candidate loci were identified using two methods: one method was utilizing CRISPOR, a bioinformatics method to predict off-target sites with Cas9 activity, and the second method was empirically determining off-target Cas9 loci using CIRCLE-seq on gDNA harvested from the liver of an untreated $NPC1^{I1061T}$ mouse. Amplicon sequencing was then performed to confirm editing at eight total candidate loci identified by either method. Only a single confirmed off-target site was observed, an intronic sequence in Epas1>3 kb away from the nearest exonic sequences, which was edited at a low efficiency of 0.3±0.05% (FIGS. 29A-29D).

Figure 21A:
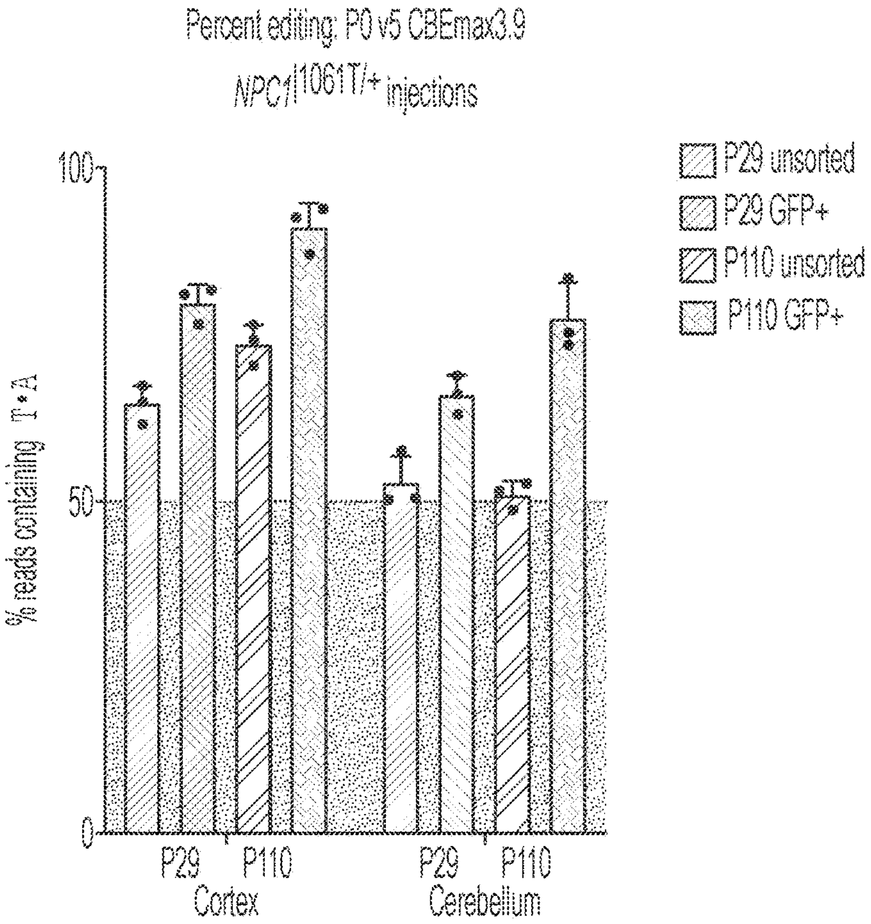
FIGS. 21A-21D show the prolonged expression of a nucleobase editor.
Figure 21B:
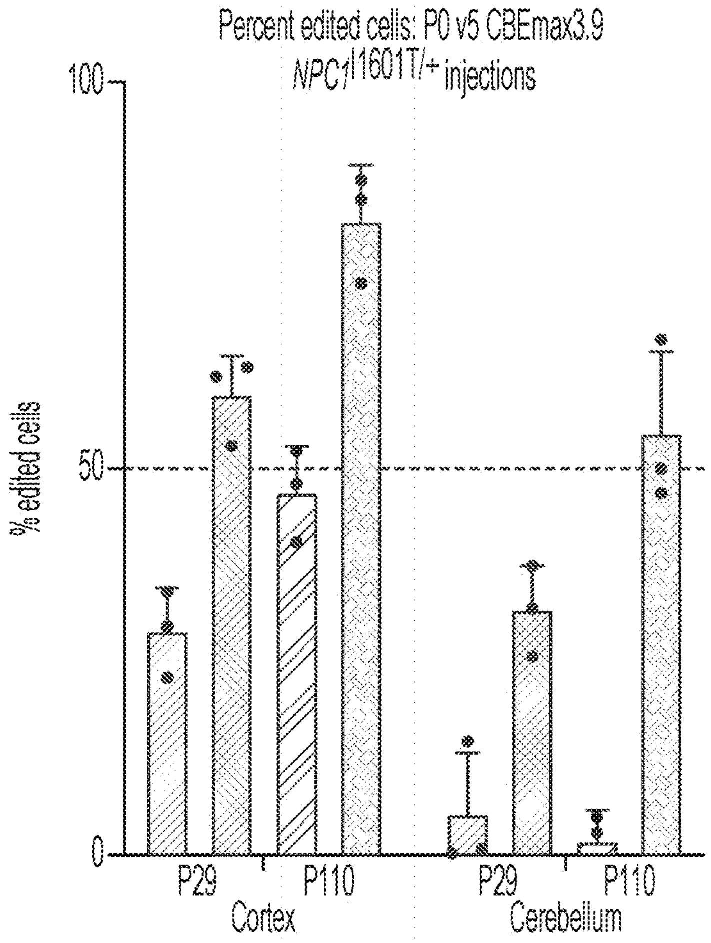

Previous work with mosaic animals' has shown that approximately 30-40% wild-type cells are required for measurable phenotypic improvement. Since the above data suggest ~11% Purkinje cell editing in low-dose animals with no lifespan extension, and ~42% Purkinje cell editing in medium-dose animals with modest but significant lifespan extension, the results broadly agree with the modest lifespan gains observed in mosaic animal studies[67]. It is noted that unedited cells may have degenerated, and thus editing levels in sequenced tissue represent upper limits of the initial percentage of edited cells. To minimize the effect of degeneration on the frequency of edited cells, base editing was measured in heterozygous $NPC1^{I1061T/+}$ mice, which do not show NPC1 disease phenotypes, following medium-dose P0 injections. At P29, it was found that 31±5.8% of GFP-positive cerebellar nuclei were edited, which increased to 54±10% at P110. In sorted cortical nuclei, the percent of edited cells increased from 59±5.4% to 82±7.2% (FIGS. 21A-21B), suggesting that C·G to T·A editing continues for more than four weeks after P0 injection.

Figure 21C:
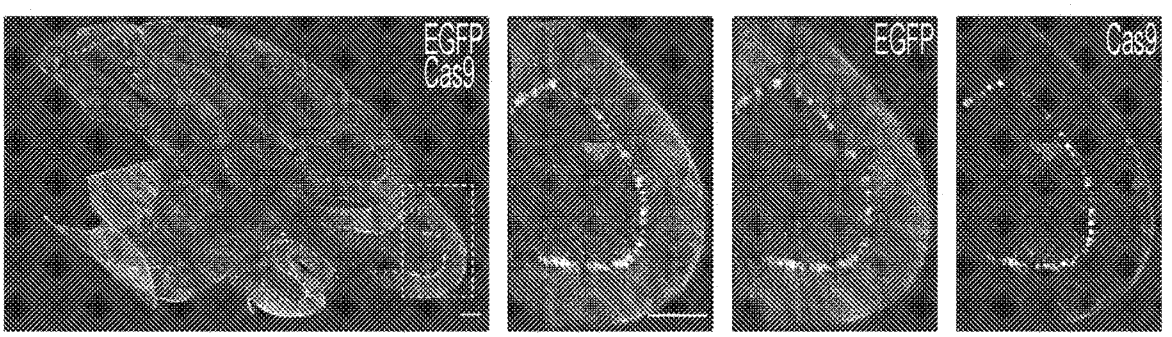
Figure 21D:
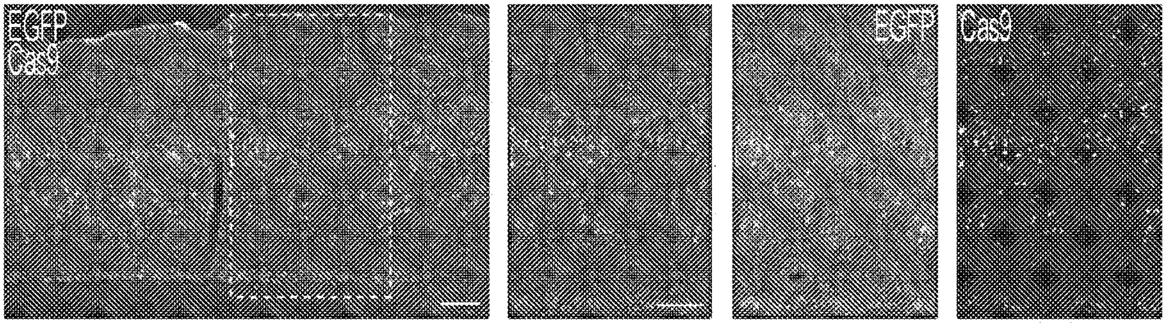

To test whether CBE is chronically expressed, $NPC1^{+/+}$ mice were injected with v5 AAV-CBE at P0 and brains were harvested at P110 for staining against Cas9 and GFP. Expression of both Cas9 and GFP was observed at P110 in cerebellar and cortical tissue (FIGS. 21B-21C), suggesting that, consistent with previous studies, AAV mediates long-term neuronal transgene expression. Although the above data are consistent with a prolonged editing activity window, and though $NPC1^{+/-}$ heterozygotes do not have any cellular markers of disease[67], the possibility that the apparent continued editing in heterozygotes may simply be the result of a survival advantage in edited cells cannot be ruled out.

These results establish that dual AAV split-intein nucleobase editor delivery in Niemann-Pick type C mice directly corrects a substantial fraction of pathogenic alleles in the CNS. Together, these results demonstrate for the first time base editing to treat an animal model of a human CNS disease, correcting the causal mutation and prolonging lifespan.

Discussion

This study describes an optimized dual AAV system that delivers split-intein cytosine and adenine nucleobase editors, resulting in therapeutically relevant in vivo genome editing efficiencies following injection of ~$10^{13}$-$10^{14}$ vg/kg, a dosage comparable to those currently used in human gene therapy trials[32]. The optimizations described above greatly improve the efficiency of AAV-encoded nucleobase editors and may also be useful to other AAV-based systems for the delivery of genome editing agents[8,22]. Many somatic cell types of therapeutic and scientific interest can be efficiently transduced with known AAV variants, including hematopoetic cells[68], liver[69], sensory organs[11], and CNS[32], suggesting that this work may facilitate a broad range of studies in animal models of many human genetic diseases. Finally, different injection routes were tested to deliver AAV-packaged split-base editors in postnatal mice and demonstrate, for the first time, efficient base editing in brain and retina, enabling causal gene correction and partial phenotypic rescue of Niemann-Pick type C disease.

The mouse studies described here use AAV injections of no more than $4\times10^{12}$ vg per 20-g animal, which corresponds to a maximum dose of $2\times10^{14}$ vg/kg, consistent with the maximum dosages delivered intravenously in non-human primate studies' and clinical trials[32] for CNS delivery. Notably, in the eye, subretinal injections of the optimized nucleobase editor AAVs achieve genome editing efficiencies comparable to those of preclinical delivery systems optimized for retinal editing[60]. Intravenous v5 AAV injections also achieve therapeutically relevant editing levels in liver, muscle, and cardiac tissue. The viral base editing systems developed in this study therefore are suitable for testing base editing strategies in animal models of human disease, a key step in advancing base editing towards human therapeutic application. AAV optimization (FIGS. 11A-11E) reduced the viral dose required for efficient base editing to amounts known to be tolerated by humans, enabling more practical and therapeutically relevant editing in animal models of human genetic diseases compared to the much higher doses previously used in trans-splicing mRNA viral vectors[8].

While it was initially anticipated that the requirement of simultaneous transduction by two viruses would sharply lower editing efficiencies, the surprisingly high overall in vivo editing efficiencies observed even among unsorted cells (for example, up to 59% of cortex), together with similar levels of transduction of single AAVs expressing GFP (FIG. 13B) strongly suggest that transducible cells are particularly amenable to transduction by multiple AAVs. Editing efficiency may be further increased by tissue-specific optimization such as selection of a delivery route that biases AAV concentrations towards relevant tissues, such as hepatic artery injections to transduce liver[71], and tissue-specific promoter and terminator variation to enhance expression in specific cell types.

The split-intein nucleobase editor delivery system developed here brings the strengths of base editing, including high editing efficiency, minimization of unwanted byproducts arising from double-stranded DNA breaks, and compatibility with post-mitotic somatic cells[2,9], to in vivo settings in the diverse tissue types that are well-transduced by natural or engineered AAVs. The split-intein dual AAV approach described here may also facilitate the in vivo delivery of genes that are too large for a direct gene augmentation approach.

Methods

Cell Culture

HEK239T/17 (ATCC CRL-11268) and 3T3 cells (ATCC CRL-1658) were maintained in DMEM (Thermo Fisher 10569044) supplemented with 10% (v/v) fetal bovine serum (Thermo Fisher), at 37° C. with 5% CO2. Cells were verified to be free of *mycoplasma* by ATCC upon purchase, and periodically during culture.

HEK293T and 3T3 Transfection and Genomic DNA Preparation

HEK293T cells were seeded into 48-well Poly-D-Lysine-coated plates (Corning 354509) at 30,000 cells/well. One day after plating, cells were transfected by Lipofectamine 2000 (Thermo Fisher) according to the manufacturer's directions with 1 μg DNA in a 1:1 molar ratio of nucleobase editor and sgRNA plasmids, plus 10 ng of fluorescent protein expression plasmid as a transfection control. Cells were cultured for 3 days before genomic DNA was extracted by replacement of culture media with 100 μL lysis buffer (10 mM Tris-HCl, pH 7.5, 0.05% SDS, 25 μg/mL proteinase K (NEB) and 37° C. incubation for 1 hour. Proteinase K was inactivated by 30-minute incubation at 80° C. 3T3 cells were transfected using the same procedure at 50,000 cells/well.

Western Blotting

HEK293T cells were seeded into 12-well plates at 125,000 cells per well. Cells were transfected as described above with all amounts scaled up 3x. For conditions with transfection of only one split-half, EGFP-expressing plasmid was used to normalize the amount of DNA used. 3 days after transfection, cells were gently lifted and triturated by pipetting PBS across the well surface. 10% of the volume was removed for HTS analysis, and the remaining cells were washed with ice-cold PBS, and incubated on ice for 15 minutes in lysis buffer (300 mM NaCl, 50 mM Tris pH 8, 1% IGEPAL 0.5% deoxycholic acid, 10 mM MgCl) plus 25 U/mL salt active nuclease (Arcticzymes 70910-202) to reduce lysate viscosity and complete EDTA-free protease inhibitor cocktail (Roche). After 10 minutes, SDS and EDTA were added to 0.5% and 1 mM, respectively, and lysates were rocked an additional 15 minutes at 4° C. before clarification by centrifugation at 14,000 g for 15 minutes at 4° C. Lysates were normalized using BCA (Pierce BCA Protein Assay Kit), and 2.5 mg of reduced protein was loaded onto each gel lane. Transfer was performed with an iBlot 2 dry blotting system (Thermo Fisher) using the following program: 20 V for 1 minute, then 23 V for 4 minutes, then 25 V for 2 minutes for a total transfer time of 7 minutes. Blocking was performed at room temperature for 30 minutes with block buffer: 1% BSA in TBST (150 mM NaCl, 0.5% Tween-20, 50 mM Tris-Cl, pH 7.5). Membranes were then incubated in primary antibody diluted in block buffer at 4° C. overnight. After a wash step, secondary antibodies diluted in TBST were added. Membranes were washed again and imaged using a LI-COR Odyssey. Wash steps were 3×5 minute washes in TBST. Primary antibodies used were rabbit anti-GAPDH, 1:1000 (Cell Signaling Technologies D16H11); rabbit anti-HA, 1:1000 (Cell Signaling Technologies C29F4), mouse anti-FLAG 1 μg/mL (clone M2, Sigma F1804). LI-COR IRDye 680RD goat anti-rabbit (#926-68071) and goat antimouse (#926-68070) secondary antibodies were used at 1:10,000-1:20,000 dilutions.

High-Throughput Sequencing and Data Analysis

Genomic DNA was amplified by qPCR using Phusion Hot Start II DNA polymerase with use of SYBR gold for quantification. 3% DMSO was added to all gDNA PCR reactions. To minimize PCR bias, reactions were stopped during the exponential amplification phase. 1 uL of the unpurified gDNA PCR product was used as a template for subsequent barcoding PCR (8 cycles, annealing temperature 61° C.). Pooled barcoding PCR products were gel-extracted (Min-elute columns, Qiagen) and quantified by qPCR (KAPA KK4824) or Qubit dsDNA HS assay kit (Thermo Fisher). Sequencing of pooled amplicons was performed using an Illumina MiSeq according to the manufacturer's instructions. All oligonucleotide sequences used for gDNA amplification are provided in FIGS. 25A-25B.

Initial de-multiplexing and FASTQ generation were performed by bcl2fastq2 running on BaseSpace (Illumina) with the following flags: -ignore-missing-bcls -ignore-missing-filter -ignore-missing-positions -ignore-missing-controls -auto-set-to-zero-barcode-mismatches -find-adapters-with-sliding-window -adapter-stringency 0.9-mask-short-adapter-reads 35-minimum-trimmed-read-length 35. Alignment of fastq files and quantification of editing frequency was performed by CRISPResso2 in batch mode with the following flags: -min_bp_quality_or_N 20-base_editor_output -p 2-w 20-wc -10.

AAV Production

AAV production was performed as previously described[24] with some alterations. HEK293T/17 cells were maintained in DMEM/10% FBS without antibiotic in 150 mm dishes (Thermo Fisher 157150), and passaged every 2-3 days. Cells for production were split 1:3 1 day before PEI transfection. 5.7 μg AAV genome, 11.4 μg pHelper (Clontech), and 22.8 μg rep-cap plasmid were transfected per plate. 1 day after transfection, media was exchanged for DMEM/5% FBS. 3 days after transfection, cells were scraped with a rubber cell scraper (Corning), pelleted by centrifugation for 10 minutes at 2000 g, resuspended in 500 μL hypertonic lysis buffer per plate (40 mM Tris base, 500 mM NaCl, 2 mM $MgCl_2$ with 100 U/mL salt active nuclease (Arcticzymes 70910-202), and incubated at 37° C. for 1 h to lyse cells.

Media was decanted, combined with a 5× solution of 40% PEG in 2.5 M NaCl (final concentration 8% PEG/500 mM NaCl), incubated on ice for 2 hours to facilitate PEG precipitation, and centrifuged at 3200 g for 40 minutes. The supernatant was discarded and the pellet resuspended in 500 μL lysis buffer per plate and added to the cell lysate. Incubation at 37° C. was continued for 30 minutes. Crude lysates were either incubated at 4° C. overnight or directly used for ultracentrifugation.

Cell lysates were gently clarified by centrifugation at 2000 g for 10 minutes and added to Beckman Quick-seal tubes via 16-gauge 5" disposable needles (Air-Tite N165). A discontinuous iodixanol gradient was formed by sequentially floating layers: 9 mL 15% iodixanol in 500 mM NaCl and 1×PBS-MK (1×PBS plus 1 mM $MgCl_2$ and 2.5 mM KCl), 6 mL 25% iodixanol in 1×PBS-MK, and 5 mL each of 40% and 60% iodixanol in 1×PBS-MK. Phenol red at a final concentration of 1 μg/mL was added to the 15, 25, and 60% layers to facilitate identification.

Ultracentrifugation was performed using a Ti 70 rotor in a Sorvall WX+ series ultracentrifuge (Thermo Fisher) at 58,600 rpm for 2:15 (h:mm) at 18° C. Following ultracentrifugation, roughly 4 mL of solution was withdrawn from the 40%-60% iodixanol interface via an 18-gauge needle, dialyzed with PBS containing 0.001% F-68, and ultrafiltered via 100-kD MWCO columns (EMD Millipore). The concentrated viral solution was sterile-filtered using a 0.22 μm filter, quantified via qPCR (AAVpro Titration Kit v.2, Clontech), and stored at 4° C. until use.

Animals

All experiments in live animals were approved by the Broad Institute and Massachusetts Eye and Ear Institutional and Animal Care and Use Committees. NPC1 mice were euthanized at the onset of morbidity, defined as profound ataxia leading to an inability to acquire food and water, as evidenced by a low body condition score and minimal responsiveness to touch. Wild-type C57BL/6 mice were from Charles River (#027). Jackson Labs supplied all transgenic mice: $Npc1^{tm(I1061T)Dso}$ (#027704), Ai9 (#007909), Rhodopsin-iCre (#015850), and L7-GFP (#004690).

Retro-Orbital Injections

AAV was diluted to 200 μL in 0.9% NaCl (Fresenius Kabi 918610) before injection. Anesthesia was induced with 4% isoflurane. Following induction as measured by unresponsiveness to a toe pinch, the right eye was protruded by gentle pressure on the skin, and a tuberculin syringe advanced, with the bevel facing away from the eye, into the retrobulbar sinus where AAV mix was slowly injected. For assessments of CNS editing, $1\times10^{11}$ vg GFP-KASH virus was added to the injection mix as a transduction marker. gDNA was purified from minced tissue using Agencourt DNAdvance kits (Beckman Coulter A48705) in accordance with the manufacturer's directions.

P0 Ventricle Injections

Drummond PCR pipettes (5-000-1001-X10) were pulled at ramp and passed through a Kimwipe three times, resulting in a tip size roughly 100 μm. A small amount of Fast Green was added to the AAV injection solution to assess ventricle targeting. The injection solution was loaded via front-filling using the included Drummond plungers. P0 pups were anesthetized by placement on ice for 2-3 minutes, until they were immobile and unresponsive to a toe pinch. 2 μL of injection mix was injected freehand into each ventricle. Ventricle targeting was assessed by the spread of fast green throughout the ventricles via transillumination of the head.

Nuclear Isolation and Sorting

Cerebella were separated from the brain with surgical scissors, hemispheres were separated using a scalpel, and the hippocampus and neocortex were separated from underlying midbrain tissue with a curved spatula. Nuclei were isolated from brain tissue as previously described[72]. All steps were performed on ice or at 4° C. Dissected tissue was homogenized using a glass dounce homogenizer (Sigma D8938) (20 strokes with pestle A followed by 20 strokes with pestle B) in 2 mL ice-cold EZ-PREP buffer (Sigma NUC-101). Samples were incubated for 5 minutes with an additional 2 mL EZ-PREP buffer. Nuclei were centrifuged at 500 g for 5 minutes, and the supernatant removed. Samples were resuspended with gentle pipetting in 4 mL ice-cold Nuclei Suspension Buffer (NSB) consisting of 100 μg/mL BSA and 3.33 μM Vybrant DyeCycle Violet (Thermo Fisher) in 1×PBS, and centrifuged at 500 g for 5 minutes. The supernatant was removed and nuclei were resuspended in 1-2 mL NSB, passed through a 35 μm strainer, and sorted into 200 μL Agencourt DNAdvance lysis buffer using a MoFlo Astrios (Beckman Coulter) at the Broad Institute flow cytometry core. Genomic DNA was purified according to the Agencourt DNAdvance instructions for 200 μL volume.

P14 Sub-Retinal Injections

1 μL of AAV mix for sub-retinal injections consisted of $4\times10^9$ vg of each split CBE nucleobase editor half, and $2\times10^9$ vg GFP for the PHP.B variant. The Anc80+CBE3.9max mixture was divided equally: $3.3\times10^8$ vg of each split nucleobase editor half, and $3.3\times10^8$ vg GFP. The Anc80+ABEmax mixture consisted of $4.5\times10^8$ vg of each split nucleobase editor half, and $4.5\times10^8$ vg GFP. PHP.B or Anc80 GFP alone at $5\times10^9$ vg/μL was injected into wild-type C57BL/6 mice to assess transduction efficiency. P14 mice were anesthetized by intraperitoneal of ketamine (140 mg/kg) and xylazine (14 mg/kg). Using a microscope for visualization, a small incision was made at the limbus by a 30-gauge needle, and a Hamilton syringe with a 33-gauge blunt-ended needle was used to inject 1 μL of AAV mix. Following injection, mice were placed on a 37° C. warming pad until they recovered.

Retina Dissociation and Cell Sorting

Three weeks post-injection, eyes were enucleated and stored in BGJB medium (Thermo Fisher) on ice as described previously[73]. Retinas were isolated under a fluorescent dissection microscope to record the transfected region and dissociated into single cells by incubation in solution A containing 1 mg/mL pronase (Sigma-Aldrich) and 2 mM EGTA in BGJB medium at 37° C. for 20 minutes. Solution A was gently removed, followed by adding equal amount of solution B containing 100 U/mL DNase I (New England Biolabs), 0.5% BSA, 2 mM EGTA in BGJB medium. Cells were collected and re-suspended in 1×PBS, filtered through a cell strainer (BD Biosciences, San Jose, CA), and sorted using a FACSAriaII (BD Biosciences).

Retinal Histology

Mice injected with PHP.B or Anc80 GFP alone were sacrificed 3 weeks post-injection and perfused with 4% paraformaldehyde in 1×PBS. Eyes were dissected and eye cups were embedded in OCT freezing medium. 10 μm Retinal cryosections were cut and stained with DAPI. Images were taken using an Eclipse Ti microscope (Nikon).

Brain Immunohistochemistry

Mice were transcardially perfused with PBS followed by 4% PFA. Harvested brains were rotated in 4% PFA at 4° C. overnight for post-fixation. Brains were transferred to 30% sucrose in 1×PBS for cryoprotection and rotated at 4° C. until equilibrated, as assessed by loss of buoyancy. Cryoprotected brains were frozen in a dry ice-ethanol bath and sectioned horizontally on a Leica CM1950 at 20 p.m. Slides were rinsed with 10 mM glycine in PBS before blocking and permeabilization in 3% BSA (Jackson Immunoresearch) and 0.1% Trition-X 100 in PBS. Slides were incubated in primary antibody at 4° C. overnight, washed three times for 10 minutes each with PBS containing 0.1% Triton-X (PBSTx), incubated with secondary antibody at room temperature for 1 hour, washed 3×10 minutes with PBSTx, and mounted in ProLong Diamond Antifade with DAPI (Thermo Fisher). Slides were cured overnight at room temperature before imaging. Care was taken to minimize light exposure at all steps. Primary antibodies used were as follows: chicken anti-GFP, 10 μg/mL (Abcam ab13970); rabbit anti-RFP, 1.6 μg/mL (Rockland 600-401-379); rabbit anti-Calbindin, 0.1 μg/mL. (Cell Signaling Technology D1I4Q). Alexa-conjugated goat secondary antibodies (Thermo Fisher) were used at 1:500. Images were captured and stitched at 10× magnification using a Zeiss Axio Scan.Z1. Image intensity was kept below 50% saturation to prevent oversaturation.

Image Analysis

Images were analyzed using ImageJ (Fiji), ilastik[74], and CellProfiler[75]. A subset of images were manually analyzed by a blinded experimenter to validate the accuracy of the final imaging pipelines. Differences between the automated and manual counts were <10%.

Off-Target Analysis

CIRCLE-seq was performed as previously described[76]. PCR amplification before sequencing was conducted using PhusionU polymerase, and products were gel-purified and quantified with a KAPA library quantification kit before loading onto an Illumina MiSeq. Data was processed using the CIRCLE-Seq analysis pipeline with parameters: "read_threshold: 4; window_size: 3; mapq_threshold: 50; start_threshold: 1; gap_threshold: 3; mismatch_threshold: 6; merged_analysis: True". The three sites found by CIRCLE-seq analysis were chosen for PCR amplification and high-throughput sequencing. CRISPOR analysis[77] was done and the top five offtarget candidates by CFD score were analyzed by amplicon sequencing.

$NPC1^{I1061T}$ Survival Measurements $NPC1^{I1061T}$ mice were euthanized at the onset of morbidity, defined functionally as profound ataxia leading to an inability to acquire food and water, as evidenced by a low body condition score[78,79] and minimal responsiveness to touch. In all cases, low body condition score preceded profound ataxia. Profound ataxia was the diagnostic criterion for morbundity. The endpoint was designed to minimize suffering while providing accurate survival data. Euthanasia recommendations were made by a blinded veterinary technician. All survival groups were mixed-gender.

Statistical Analysis

The logrank (Mantel-Cox) test was used to compare Kaplan-Meier survival curves (GraphPad).

Data and Materials Availability

Key plasmids from this work are available from Addgene (depositor: David R. Liu) and other plasmids are available upon request. All unmodified reads for sequencing-based data in the manuscript are available from the NCBI Sequence Read Archive, accession number PRJNA532891. AAV genome sequences are provided as FIGS. 26A-26U.

REFERENCES

1 Landrum, M. J. et al. ClinVar: public archive of relationships among sequence variation and human phenotype. *Nucleic acids research* 42, D980-985, doi:10.1093/nar/gkt1113 (2014).

2 Rees, H. A. & Liu, D. R. Base editing: precision chemistry on the genome and transcriptome of living cells. *Nature reviews. Genetics* 19, 770-788, doi:10.1038/s41576-018-0059-1 (2018).

3 Komor, A. C., Kim, Y. B., Packer, M. S., Zuris, J. A. & Liu, D. R. Programmable editing of a target base in genomic DNA without double-stranded DNA cleavage. *Nature* 533, 420-424, doi:10.1038/nature17946 (2016).

4 Gaudelli, N. M. et al. Programmable base editing of A*T to G*C in genomic DNA without DNA cleavage. *Nature* 551, 464-471, doi:10.1038/nature24644 (2017).

5 Komor, A. C. et al. Improved base excision repair inhibition and bacteriophage Mu Gam protein yields C:G-to-T:A nucleobase editors with higher efficiency and product purity. *Sci Adv* 3, eaao4774, doi:10.1126/sciadv.aao4774 (2017).

6 Koblan, L. W. et al. Improving cytidine and adenine nucleobase editors by expression optimization and ancestral reconstruction. *Nature biotechnology*, doi:10.1038/nbt.4172 (2018).

7 Nishida, K. et al. Targeted nucleotide editing using hybrid prokaryotic and vertebrate adaptive immune systems. *Science* 353, doi:10.1126/science.aaf8729 (2016).

8 Ryu, S. M. et al. Adenine base editing in mouse embryos and an adult mouse model of Duchenne muscular dystrophy. *Nature biotechnology* 36, 536-539, doi:10.1038/nbt.4148 (2018).

9 Yeh, W. H., Chiang, H., Rees, H. A., Edge, A. S. B. & Liu, D. R. In vivo base editing of post-mitotic sensory cells. *Nat Commun* 9, 2184, doi:10.1038/s41467-018-04580-3 (2018).

10 Chadwick, A. C., Wang, X. & Musunuru, K. In Vivo Base Editing of PCSK9 (Proprotein Convertase Subtilisin/Kexin Type 9) as a Therapeutic Alternative to Genome Editing. *Arterioscler Thromb Vasc Biol* 37, 1741-1747, doi:10.1161/ATVBAHA.117.309881 (2017).

11 Russell, S. et al. Efficacy and safety of voretigene neparvovec (AAV2-hRPE65v2) in patients with RPE65-mediated inherited retinal dystrophy: a randomised, controlled, open-label, phase 3 trial. *Lancet* 390, 849-860, doi:10.1016/S0140-6736(17)31868-8 (2017).

12 Carvalho, L. S. et al. Evaluating Efficiencies of Dual AAV Approaches for Retinal Targeting. Front Neurosci 11, 503, doi:10.3389/fnins.2017.00503 (2017). 13 Wu, Z., Yang, H. & Colosi, P. Effect of genome size on AAV vector packaging. *Molecular therapy: the journal of the American Society of Gene Therapy* 18, 80-86, doi:10.1038/mt.2009.255 (2010).

14 Liu, D. R., Levy, Jonathan M., Yeh, Wei Hsi. AAV Delivery Of Nucleobase Editors. International Patent Application Publication No. WO 2018/027078 (2018).

15 Truong, D. J. J. et al. Development of an intein-mediated split-Cas9 system for gene therapy. *Nucleic acids research* 43, 6450-6458, doi:10.1093/nar/gkv601 (2015).

16 Zetsche, B., Volz, S. E. & Zhang, F. A split-Cas9 architecture for inducible genome editing and transcription modulation. *Nature biotechnology* 33, 139-142, doi:10.1038/nbt.3149 (2015).

17 Wright, A. V. et al. Rational design of a split-Cas9 enzyme complex. *Proc Natl Acad Sci USA* 112, 2984-2989, doi:10.1073/pnas.1501698112 (2015).

18 Zettler, J., Schutz, V. & Mootz, H. D. The naturally split Npu DnaE intein exhibits an extraordinarily high rate in the protein trans-splicing reaction. *FEBS letters* 583, 909-914, doi:10.1016/j.febslet.2009.02.003 (2009).

19 Davis, K. M., Pattanayak, V., Thompson, D. B., Zuris, J. A. & Liu, D. R. Small molecule-triggered Cas9 protein with improved genome-editing specificity. *Nat Chem Biol* 11, 316-318, doi:10.1038/nchembio.1793 (2015).

20 Stevens, A. J. et al. Design of a Split Intein with Exceptional Protein Splicing Activity. *J Am Chem Soc* 138, 2162-2165, doi:10.1021/jacs.5b13528 (2016).

21 Kim, Y. B. et al. Increasing the genome-targeting scope and precision of base editing with engineered Cas9-cytosine deaminase fusions. *Nature biotechnology* 35, 371-376 (2017).

22 Villiger, L. et al. Treatment of a metabolic liver disease by in vivo genome base editing in adult mice. *Nature medicine* 24, 1519-1525, doi:10.1038/s41591-018-0209-1 (2018).

23 Grieger, J. C. & Samulski, R. J. Packaging capacity of adeno-associated virus serotypes: impact of larger genomes on infectivity and postentry steps. *Journal of virology* 79, 9933-9944, doi:10.1128/JVI.79.15.9933-9944.2005 (2005).

24 Deverman, B. E. et al. Cre-dependent selection yields AAV variants for widespread gene transfer to the adult brain. *Nature biotechnology* 34, 204-209, doi:10.1038/nbt.3440 (2016).

25 Choi, J. H. et al. Optimization of AAV expression cassettes to improve packaging capacity and transgene expression in neurons. *Mol Brain* 7, 17, doi:10.1186/1756-6606-7-17 (2014).

26 Zuris, J. A. et al. Cationic lipid-mediated delivery of proteins enables efficient protein-based genome editing in vitro and in vivo. *Nature biotechnology* 33, 73-80, doi:10.1038/nbt.3081 (2015).

27 Rees, H. A. et al. Improving the DNA specificity and applicability of base editing through protein engineering and protein delivery. *Nat Commun* 8, 15790, doi:10.1038/ncomms15790 (2017).

28 Gray, S. J. et al. Optimizing promoters for recombinant adeno-associated virus-mediated gene expression in the peripheral and central nervous system using self-complementary vectors. *Hum Gene Ther* 22, 1143-1153, doi:10.1089/hum.2010.245 (2011).

29 Swiech, L. et al. In vivo interrogation of gene function in the mammalian brain using CRISPR-Cas9. *Nature biotechnology* 33, 102-106, doi:10.1038/nbt.3055 (2015).

30 Feng, J. et al. Dnmt1 and Dnmt3a maintain DNA methylation and regulate synaptic function in adult forebrain neurons. *Nature neuroscience* 13, 423-430, doi:10.1038/nn.2514 (2010).

31 Ran, F. A. et al. In vivo genome editing using *Staphylococcus aureus* Cas9. *Nature* 520, 186-191, doi:10.1038/nature14299 (2015).

32 Mendell, J. R. et al. Single-Dose Gene-Replacement Therapy for Spinal Muscular Atrophy. *N Engl J Med* 377, 1713-1722, doi:10.1056/NEJMoa1706198 (2017).

33 Wu, Z., Asokan, A. & Samulski, R. J. Adeno-associated virus serotypes: vector toolkit for human gene therapy. *Molecular therapy: the journal of the American Society of Gene Therapy* 14, 316-327, doi:10.1016/j.ymthe.2006.05.009 (2006).

34 Duan, D. Systemic AAV Micro-dystrophin Gene Therapy for Duchenne Muscular Dystrophy. *Molecular therapy: the journal of the American Society of Gene Therapy*, doi:10.1016/j.ymthe.2018.07.011 (2018).

35 Inagaki, K. et al. Robust systemic transduction with AAV9 vectors in mice: efficient global cardiac gene transfer superior to that of AAV8. *Molecular therapy: the journal of the American Society of Gene Therapy* 14, 45-53, doi:10.1016/j.ymthe.2006.03.014 (2006).

36 Duan, D., Yue, Y. & Engelhardt, J. F. Expanding AAV packaging capacity with trans-splicing or overlapping vectors: a quantitative comparison. *Molecular therapy: the journal of the American Society of Gene Therapy* 4, 383-391, doi:10.1006/mthe.2001.0456 (2001).

37 Xu, Z. et al. Trans-splicing adeno-associated viral vector-mediated gene therapy is limited by the accumulation of spliced mRNA but not by dual vector coinfection efficiency. *Hum Gene Ther* 15, 896-905, doi:10.1089/hum.2004.15.896 (2004).

38 van Putten, M. et al. Low dystrophin levels increase survival and improve muscle pathology and function in dystrophin/utrophin double-knockout mice. *FASEB journal: official publication of the Federation of American Societies for Experimental Biology* 27, 2484-2495, doi:10.1096/fj.12-224170 (2013).

39 Li, D., Yue, Y. & Duan, D. Marginal level dystrophin expression improves clinical outcome in a strain of dystrophin/utrophin double knockout mice. PloS one 5, e15286, doi:10.1371/journal.pone.0015286 (2010).

40 Tuchman, M., Jaleel, N., Morizono, H., Sheehy, L. & Lynch, M. G. Mutations and polymorphisms in the human ornithine transcarbamylase gene. *Hum Mutat* 19, 93-107, doi:10.1002/humu.10035 (2002).

41 Treacy, E. P. et al. Analysis of Phenylalanine Hydroxylase Genotypes and Hyperphenylalaninemia Phenotypes Using L-[1-13C]Phenylalanine Oxidation Rates in Vivo: A Pilot Study 1. *Pediatric Research* 42, 430, doi:10.1203/00006450-199710000-00002 (1997).

42 Hamman, K. et al. Low therapeutic threshold for hepatocyte replacement in murine phenylketonuria. *Molecular therapy: the journal of the American Society of Gene Therapy* 12, 337-344, doi:10.1016/j.ymthe.2005.03.025 (2005).

43 Zincarelli, C., Soltys, S., Rengo, G. & Rabinowitz, J. E. Analysis of AAV serotypes 1-9 mediated gene expression and tropism in mice after systemic injection. *Molecular therapy: the journal of the American Society of Gene Therapy* 16, 1073-1080, doi:10.1038/mt.2008.76 (2008).

44 Asico, L. D. et al. Nephron segment-specific gene expression using AAV vectors. *Biochem Biophys Res Commun* 497, 19-24, doi:10.1016/j.bbrc.2018.01.169 (2018).

45 Foust, K. D. et al. Intravascular AAV9 preferentially targets neonatal neurons and adult astrocytes. *Nature biotechnology* 27, 59-65, doi:10.1038/nbt.1515 (2009).

46 Mercuri, E. et al. Nusinersen versus Sham Control in Later-Onset Spinal Muscular Atrophy. *N Engl J Med* 378, 625-635, doi:10.1056/NEJMoa1710504 (2018).

47 Chan, K. Y. et al. Engineered AAVs for efficient noninvasive gene delivery to the central and peripheral nervous systems. *Nature neuroscience*, doi:10.1038/nn.4593 (2017).

48 Hordeaux, J. et al. The Neurotropic Properties of AAV-PHP.B Are Limited to C57BIJ6J Mice. *Molecular therapy: the journal of the American Society of Gene Therapy*, doi:10.1016/j.ymthe.2018.01.018 (2018).

49 Huang, Q. et al. Delivering genes across the blood-brain barrier: LY6A, a novel cellular receptor for AAV-PHP.B capsids. *bioRxiv,* 538421, doi:10.1101/538421 (2019).

50 Harvey, R. J. & Napper, R. M. Quantitative study of granule and Purkinje cells in the cerebellar cortex of the rat. *J Comp Neurol* 274, 151-157, doi:10.1002/cne.902740202 (1988).

51 Vogel, M. W., Sunter, K. & Herrup, K. Numerical matching between granule and Purkinje cells in lurcher chimeric mice: a hypothesis for the trophic rescue of granule cells from target-related cell death. *The Journal of neuroscience: the official journal of the Society for Neuroscience* 9, 3454-3462 (1989).

52 Kim, J. Y. et al. Viral transduction of the neonatal brain delivers controllable genetic mosaicism for visualising and manipulating neuronal circuits in vivo. *Eur J Neurosci* 37, 1203-1220, doi:10.1111/ejn.12126 (2013).

53 Kim, J. Y., Grunke, S. D., Levites, Y., Golde, T. E. & Jankowsky, J. L. Intracerebroventricular viral injection of the neonatal mouse brain for persistent and widespread neuronal transduction. *Journal of visualized experiments: JoVE,* 51863, doi:10.3791/51863 (2014).

54 Hoxha, E., Balbo, I., Miniaci, M. C. & Tempia, F. Purkinje Cell Signaling Deficits in Animal Models of Ataxia. *Front Synaptic Neurosci* 10, 6, doi:10.3389/fnsyn.2018.00006 (2018).

55 Matilla-Duenas, A. et al. Consensus paper: pathological mechanisms underlying neurodegeneration in spinocerebellar ataxias. *Cerebellum* 13, 269-302, doi:10.1007/s12311-013-0539-y (2014).

56 Chakrabarty, P. et al. Capsid serotype and timing of injection determines AAV transduction in the neonatal mice brain. *PloS one* 8, e67680, doi:10.1371/journal-.pone.0067680 (2013).

57 Madisen, L. et al. A robust and high-throughput Cre reporting and characterization system for the whole mouse brain. *Nature neuroscience* 13, 133-140, doi:10.1038/nn.2467 (2010).

58 Zinn, E. et al. In Silico Reconstruction of the Viral Evolutionary Lineage Yields a Potent Gene Therapy Vector. *Cell Rep* 12, 1056-1068, doi:10.1016/j.celrep.2015.07.019 (2015).

59 Koch, S. F. et al. Genetic rescue models refute nonautonomous rod cell death in retinitis pigmentosa. *Proc Natl Acad Sci USA* 114, 5259-5264, doi:10.1073/pnas.1615394114 (2017).

60 Maeder, M. L. et al. Development of a gene-editing approach to restore vision loss in Leber congenital amaurosis type 10. *Nature medicine, doi:*10.1038/s41591-018-0327-9 (2019).

61 Park, W. D. et al. Identification of 58 novel mutations in Niemann-Pick disease type C: correlation with biochemical phenotype and importance of PTC1-like domains in NPC1. *Hum Mutat* 22, 313-325, doi:10.1002/humu.10255 (2003).

62 Praggastis, M. et al. A murine Niemann-Pick C1 I1061T knock-in model recapitulates the pathological features of the most prevalent human disease allele. *The Journal of neuroscience: the official journal of the Society for Neuroscience* 35, 8091-8106, doi:10.1523/JNEUROSCI.4173-14.2015 (2015).

63 Yu, T., Shakkottai, V. G., Chung, C. & Lieberman, A. P. Temporal and cell-specific deletion establishes that neuronal Npc1 deficiency is sufficient to mediate neurodegeneration. *Human Molecular Genetics* 20, 4440-4451, doi:10.1093/hmg/ddr372 (2011).

64 Loftus, S. K. et al. Rescue of neurodegeneration in Niemann-Pick C mice by a prion-promoter-driven Npc1 cDNA transgene. *Hum Mol Genet* 11, 3107-3114 (2002).

65 Lopez, M. E., Klein, A. D., Dimbil, U. J. & Scott, M. P. Anatomically defined neuron-based rescue of neurodegenerative Niemann-Pick type C disorder. *The Journal of neuroscience: the official journal of the Society for Neuroscience* 31, 4367-4378, doi:10.1523/JNEUROSCI.5981-10.2011 (2011).

66 Elrick, M. J. et al. Conditional Niemann-Pick C mice demonstrate cell autonomous Purkinje cell neurodegeneration. *Human Molecular Genetics* 19, 837-847, doi:10.1093/hmg/ddp552 (2010).

67 Ko, D. C. et al. Cell-autonomous death of cerebellar purkinje neurons with autophagy in Niemann-Pick type C disease. *PLoS Genet* 1, 81-95, doi:10.1371/journal.pgen.0010007 (2005).

68 Ling, C. et al. High-Efficiency Transduction of Primary Human Hematopoietic Stem/Progenitor Cells by AAV6 Vectors: Strategies for Overcoming Donor-Variation and Implications in Genome Editing. *Scientific reports* 6, 35495, doi:10.1038/srep35495 (2016).

69 Nathwani, A. C. et al. Long-term safety and efficacy of factor IX gene therapy in hemophilia B. *N Engl J Med* 371, 1994-2004, doi:10.1056/NEJMoa1407309 (2014).

70 Hinderer, C. et al. Severe Toxicity in Nonhuman Primates and Piglets Following High-Dose Intravenous Administration of an Adeno-Associated Virus Vector Expressing Human SMN. *Hum Gene Ther*, doi:10.1089/hum.2018.015 (2018).

71 Manno, C. S. et al. Successful transduction of liver in hemophilia by AAV-Factor IX and limitations imposed by the host immune response. *Nature medicine* 12, 342-347, doi:10.1038/nm1358 (2006).

72 Habib, N. et al. Massively parallel single-nucleus RNA-seq with DroNc-seq. *Nature methods* 14, 955-958, doi:10.1038/nmeth.4407 (2017).

73 Li, P. et al. Allele-Specific CRISPR-Cas9 Genome Editing of the Single-Base P23H Mutation for Rhodopsin-Associated Dominant Retinitis Pigmentosa. *The CRISPR Journal* 1, 55-64, doi:10.1089/crispr.2017.0009 (2018).

74 Sommer, C., Strähle, C., Köthe, U. & Hamprecht, F. A. in *Eighth IEEE International Symposium on Biomedical Imaging* (*ISBI*2011). 230-233.

75 Carpenter, A. E. et al. CellProfiler: image analysis software for identifying and quantifying cell phenotypes. *Genome Biol* 7, R100, doi:10.1186/gb-2006-7-10-r100 (2006).

76 Tsai, S. Q. et al. CIRCLE-seq: a highly sensitive in vitro screen for genome-wide CRISPR-Cas9 nuclease off-targets. Nature methods 14, 607-614, doi:10.1038/nmeth.4278 (2017).

77 Haeussler, M. et al. Evaluation of off-target and on-target scoring algorithms and integration into the guide RNA selection tool CRISPOR. Genome Biol 17, 148, doi:10.1186/s13059-016-1012-2 (2016).

78 Ullman-Cullere, M. H. & Foltz, C. J. Body condition scoring: a rapid and accurate method for assessing health status in mice. Lab Anim Sci 49, 319-323 (1999).

79 Foltz, C. & Ullman-Cullere, M. Guidelines for Assessing the Health and Condition of Mice. Lab Animal 28 (1998).

80 Langmade, S. J. et al. Pregnane X receptor (PXR) activation: a mechanism for neuroprotection in a mouse model of Niemann-Pick C disease. Proc Natl Acad Sci USA 103, 13807-13812, doi:10.1073/pnas.0606218103 (2006).

81 Hughes, M. P. et al. AAV9 intracerebroventricular gene therapy improves lifespan, locomotor function and pathology in a mouse model of Niemann-Pick type C1 disease. Hum Mol Genet 27, 3079-3098, doi:10.1093/hmg/ddy212 (2018).

82 L. D. Landegger, B. Pan, C. Askew, S. J. Wassmer, S. D. Gluck, A. Galvin, R. Taylor, A. Forge, K. M. Stankovic, J. R. Holt, L. H. Vandenberghe, A synthetic AAV vector enables safe and efficient gene transfer to the mammalian inner ear. *Nature Biotechnology* 35,28 0-284 (2017).

83 B. W. Thuronyi, L. W. Koblan, J. M. Levy, W.-H. Yeh, C. Zheng, G. A. Newby, C. Wilson, M. Bhaumik, O. Shubina-Oleinik, J. R. Holt, D. R. Liu, Continuous evolution of nucleobase editors with expanded target compatibility and improved activity. *Nature Biotechnology*, (2019).

Example 4: Editing of TMC1 Gene in Baringo Mice Using AAV Encoded Split Nucleobase Editor Sensory hair cells of Baringo mice have a complete loss of auditory sensory transduction and thus are profoundly deaf. The Baringo ($Tmc1^{Y182C/Y182C}$; $Tmc2^{+/+}$) mouse model is homozygous for a recessive loss-of-function T·A-to-C·G mutation in Tmc1 (c.A545G) that substitutes Tyr 182 for Cys (p.Y182C), results in profound deafness by 4 weeks of age. TMC1 protein is required for proper sensory transduction in hair cells of the cochlea. To repair the p.Y182C mutation several optimized cytidine nucleobase editors (CBEmax variants) and guide RNAs were tested in Baringo mouse embryonic fibroblasts. The most promising CBE, derived from an activation-induced cytosine deaminase (AID), was packaged into dual AAV vectors using a split-intein system. The dual AID-CBEmax AAVs were injected into the inner ears of Baringo mice at postnatal day 1 (P1). Injected mice showed up to 51% correction of the c.A545G point mutation in Tmc1 transcripts, which restored the wild-type Tmc1 coding sequence (c.A545A) in sensory hair cells of the inner ear. Repair of Tmc1 in vivo rescued hair-cell sensory transduction, hair-cell morphology, and substantial low-frequency hearing four weeks post-injection.

Base Editing Tmc1 In Vitro

Figure 30A:
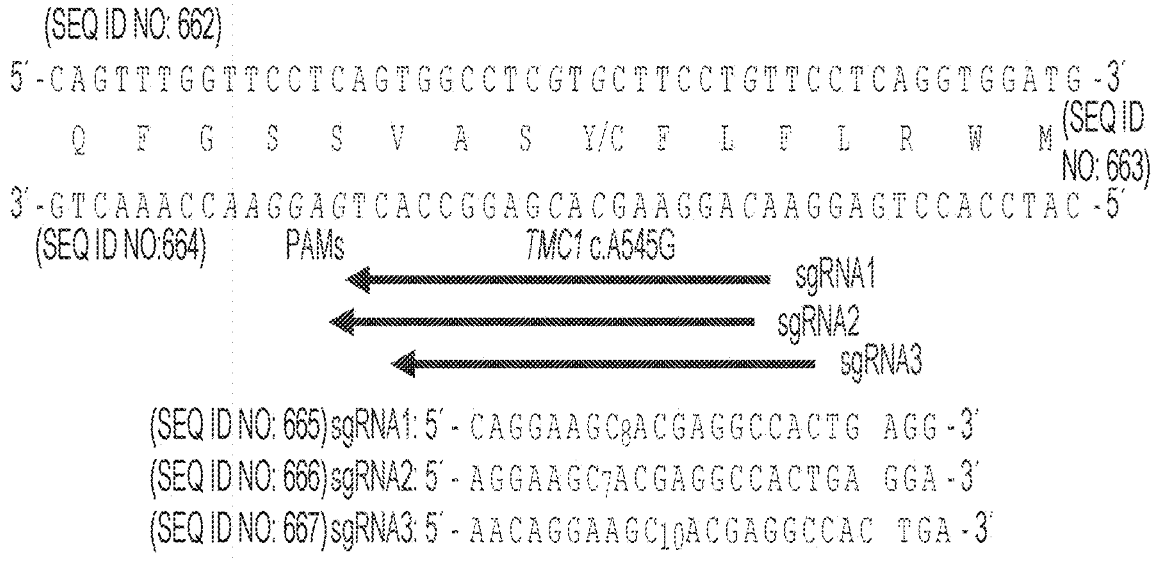
FIGS. 30A-30D show how evaluating different nucleobase editors and guide RNA can correct the $Tmc1^{Y182C/Y182C}$ allele in Baringo MEF cells.

To develop a base editing strategy capable of correcting the Baringo mutation (Tmc1 c.A545G), protospacer sequences at the target site were searched. Three protospacer-adjacent motifs (PAMs) were identified that allow binding of *S. pyogenes* Cas9 (SpCas9, AGG PAM) or the engineered VRQR SpCas9 variant (GGA or TGA PAM) to the target locus in a manner that positions the target Tmc1 nucleotide within or near the cytosine base editing activity window (approximately protospacer positions 4-8, counting the PAM as positions 21-23). Three candidate guide RNAs position this target C:G base pair at protospacer position 8 (sgRNA1, AGG PAM), position 7 (sgRNA2, GGA PAM), or position 10 (sgRNA3, TGA PAM) (FIG. 30A).

Figure 34:
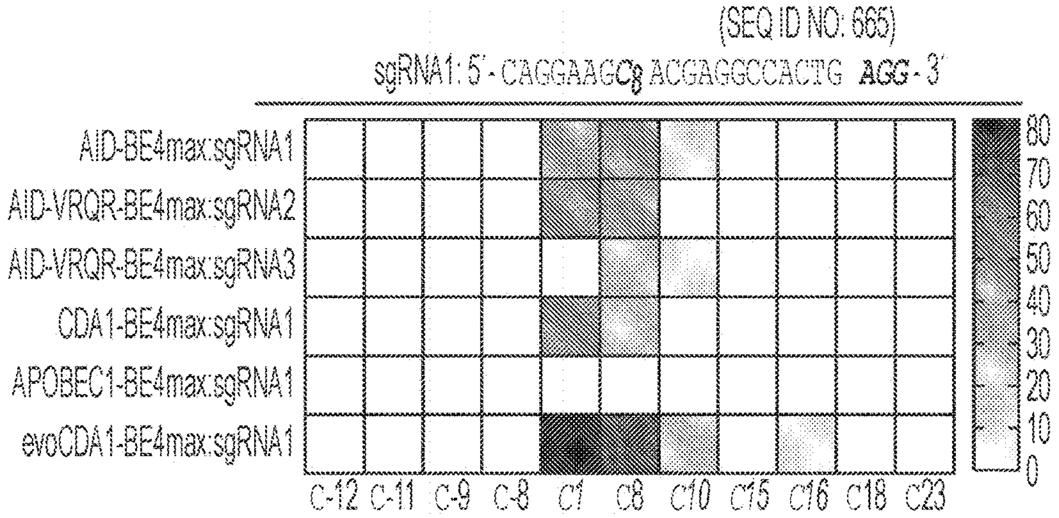
FIG. 34 shows the base editing outcomes from different CBE and sgRNA combinations. The heat map shows an average base editing efficiency by BE4max variants at cytosines surrounding the target nucleotide. The target Tmc1$^{Y182C/Y182C}$ mutation is at protospacer position 8. Silent bystander cytosines are at positions 1, 10, 15, and 16. Non-silent bystander cytosines are at positions −12, −11, −9, −8, 18, and 23.

Potential bystander edits near the target nucleotide in Tmc1, which is located in the sequence 5' . . . AACAG-GAAGC ACGAGGCCAC . . . 3' (SEQ ID NO: 513), were considered. When the target nucleotide is at protospacer position 8 ($C_8$), no other C nucleotides lie within the canonical CBE activity window (18). The closest bystander C, at protospacer position 10, if edited to a T would result in a silent mutation, because both TCG and TCA on the opposite DNA strand encode Serine. The nearest non-silent Cs are located at $C_{-8}$ and $C_{15}$, well outside the base editing activity window when using any of the three candidate sgRNAs described above (FIG. 30A). Thus, anticipated products of base editing should revert Cys 182 back to Tyr, with minimal other non-synonymous amino acid changes (FIG. 34).

The target Tmc1 nucleotide is in an AGC sequence context. It was previously noted that APOBEC1-derived CBEs (including the commonly used BE3 and BE4 variants), edit GC targets less efficiently, consistent with the known DNA sequence preferences of APOBEC1 deaminase. In contrast with APOBEC1, the CDA1 deaminase from *P. marinus*, and human AID deaminase both deaminate GC substrates efficiently. To compare the activity of CDA1- and AID-derived nucleobase editors at the Baringo mutation site, nuclear localization-optimized, codon-optimized BE4max (also known as APOBEC1-BE4max) that replaces APOBEC1 with CDA1 (resulting in CDA1-BE4max) was constructed, with a highly active laboratory-evolved CDA1 variant recently described[83] (resulting in evoCDA1-BE4max), or with human AID deaminase (resulting in AID-BE4max).

Next, cells from Baringo mouse embryos were isolated to compare the editing efficiency of APOBEC1-BE4max, CDA1-BE4max, evoCDA1-BE4max, and AID-BE4max for targeting Tmc1. Mouse embryonic fibroblasts (MEFs) were extracted from Baringo embryos at day 13.5. The ability of APOBEC1-BE4max, CDA1-BE4max, evoCDA1-BE4max, and AID-BE4max to convert the target Tmc1 base pair from pathogenic C:G to wildtype T:A using sgRNA1 was evaluated.

To minimize variability from nucleobase editor expression differences among cells, plasmids encoding each nucleobase editor as a P2A-GFP fusion were constructed and GFP-positive cells were analyzed by high-throughput DNA sequencing (HTS). Since P2A is a self-cleaving peptide that couples GFP production with full-length nucleobase editor translation, GFP-positive cells must also express nucleobase editor. Baringo MEF cells were nucleofected with two-plasmid mixtures in which one plasmid expressed sgRNA1 and the other expressed APOBEC1-BE4max-P2A-GFP, CDA1-BE4max-P2A-GFP, evoCDA1-BE4max-P2A-GFP, or AID-BE4max-P2A-GFP. After three days, the GFP-positive cells were isolated and sequenced.

Figure 30B:
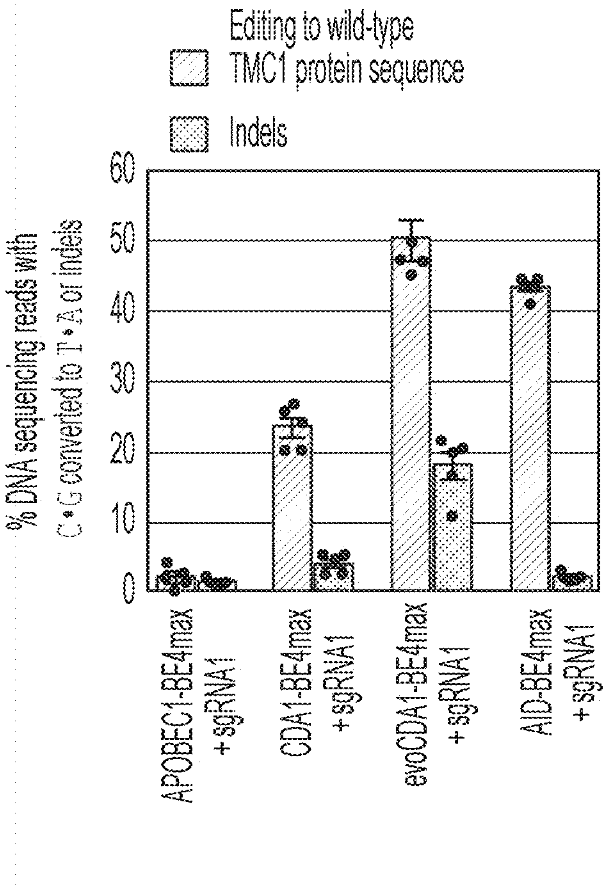

As anticipated, APOBEC1-BE4max+sgRNA1 showed inefficient (mean±SEM of 2.0±0.7%) editing at $GC_8$, likely due to the disfavored sequence context of the target C. In contrast, CDA1-BE4max resulted in 12-fold improved target base editing efficiency (23±1.4%), AID-BE4max resulted in 21-fold more efficient editing (43±0.6%), and evoCDA1-BE4max resulted in 25-fold higher editing (50±2.8%), compared to APOBEC1-BE4max (FIG. 30B). APOBEC1-BE4max, CDA1-BE4max, and AID-BE4max all induced low (1.9%) indels at the target locus, while evoCDA1-BE4max resulted in a much higher (18%±1.9%) indel frequency (FIG. 30B), consistent with previous findings[83]. The ratio of desired base edit:indels for AID-BE4max (ratio of 23) was much more favorable than for evoCDA1-BE4max (ratio of 2.7).

Figure 30C:
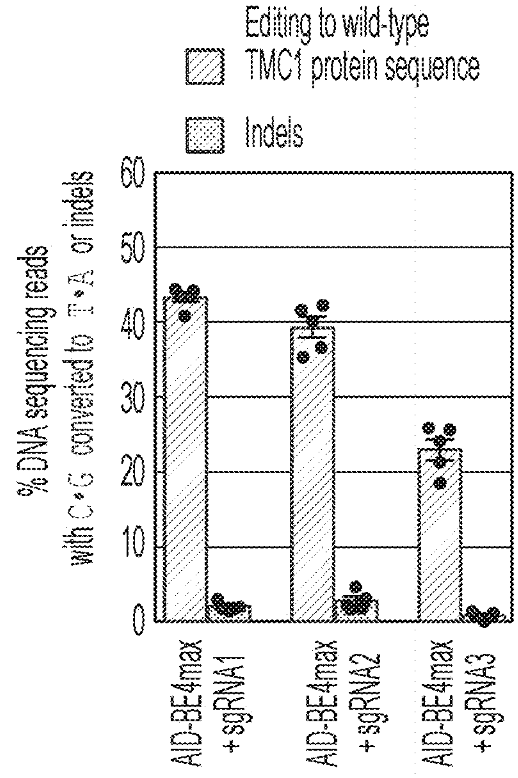

Subsequently, the effect of varying the position of the Baringo mutation among sgRNA1, sgRNA2, and sgRNA3, which place the target C at protospacer positions 8, 7, or 10, respectively, was tested (FIG. 30A). SpCas9-based AID-BE4max was used with sgRNA1 to access its AGG PAM, and used AID-VRQR-BE4max, which contains the VRQR variant of SpCas9 that is compatible with NGA PAM sites, with sgRNA2 and sgRNA3 to access their TGA or GGA PAMs, respectively. Cells were transfected with plasmids encoding each pair of nucleobase editor-P2A-GFP:sgRNA variant into Baringo MEF cells, sorted for GFP-positive cells, and analyzed them by HTS. 43±0.6% editing from AID-BE4max+sgRNA1, 39±1.4% editing from AID-VRQR-BE4max sgRNA2, and 23±1.4% editing from AID-VRQR-BE4max+sgRNA3 was observed (FIG. 30C). Since the AGG PAM accessed by sgRNA1 resulted in the highest editing efficiency, consistent with sgRNA1 placement of the target nucleotide into the canonical CBE activity window (positions 4-8), AID-BE4max+sgRNA1 using a dual-AAV delivery system was chosen for moving forward in vivo.

Dual-AAV Delivery of Tmc1-Targeted Nucleobase Editors In Vitro

Figure 35A:
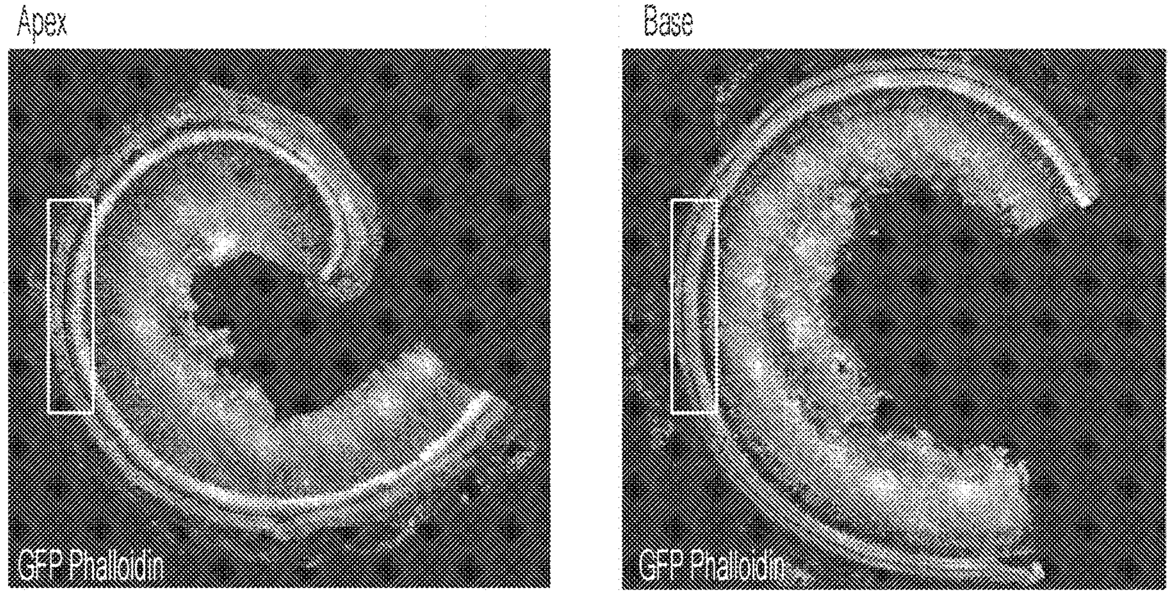
FIGS. 35A-35C show Anc80-Cbh-GFP AAV transduction in IHCs and OHCs in wild-type mice.
Figure 35B:
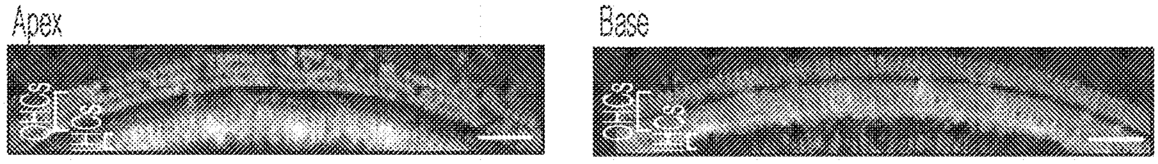
Figure 35C:
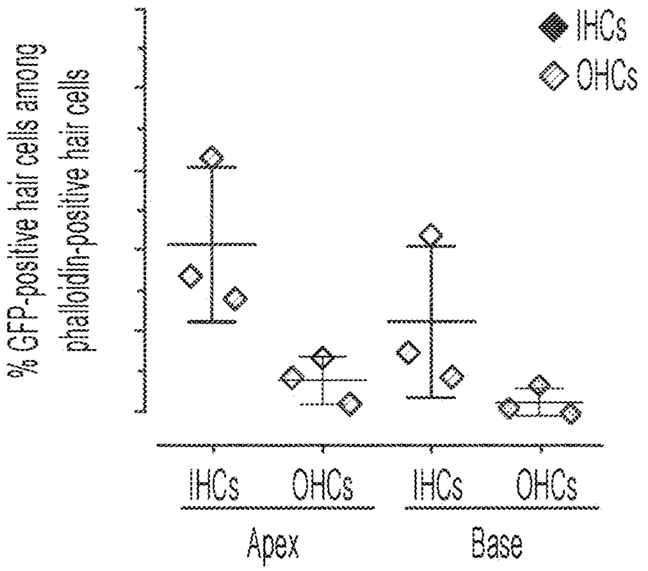

To successfully prevent mutant Tmc1-mediated hearing loss using base editing, the nucleobase editor and guide RNA, or their encoding DNA, must be delivered into cochlear hair cells in the inner ear. Anc80L65, an ancestrally reconstructed AAV hereafter referred to as Anc80, was selected due to its demonstrated safety and efficacy in the mouse inner ear[82]. To validate the ability of Anc80 to deliver genes into inner hair cells (IHCs) and outer hair cells (OHCs) of Baringo mice, $7.2\times10^8$ vg of Anc80 AAV encoding GFP driven by the chicken (3-actin hybrid (Cbh) promoter was administered by intracochlear injection into the inner ear of P1 Baringo mice. This viral dose, corresponding to $1.8\times10^9$ vg/kg, is well within the range of AAV known to be tolerated in human retina in clinical applications. High viral transduction efficiency was observed in MC (41.7% in apex and 22.6% in base of cochlea) and low transduction in OHC (8.3% in apex and 2.6% in base of cochlea) (FIGS. 35A-35C).

Since the coding sequence of nucleobase editors (~5.2 kB) exceeds the DNA capacity of AAVs, AID-BE4max was modified in two ways to enable AAV-mediated delivery. First, the nucleobase editor was divided into two halves (an N-terminal half and a C-terminal half) between Glu573 and Cys574, and fused each nucleobase editor half with one half of the Npu trans-splicing split intein. Co-expression of both nucleobase editor-intein halves results in rapid protein splicing, reconstituting full-length nucleobase editor. Second, the second uracil glycosylase inhibitor (UGI) domain was removed in each, yielding AID-BE3.9max. It was recently shown that removing the second UGI copy in split-intein CBE variants minimally affects base editing efficiency. These two changes enabled the nucleobase editor along with sgRNA1 and all necessary promoter and regulatory sequences to fit within two AAVs (≤4,849 bp each).

Figure 30D:
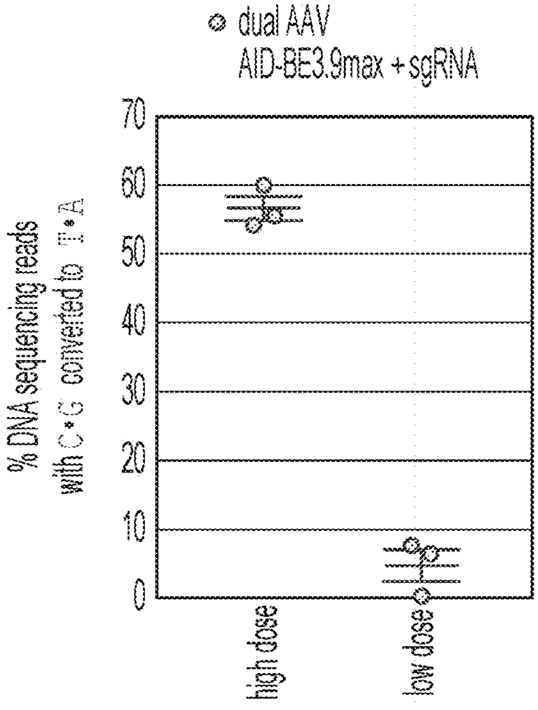

To test whether this split-intein dual AAV strategy mediated efficient base editing of Tmc1, Baringo MEF cells were transduced with dual AAVs encoding AID-BE3.9max+gRNA1 at two dosages. The high dose of the N-terminus half was $6.1\times10^8$ vg and the low dose was $3.1\times10^7$ vg; the high dose of the C-terminus half was $8.3\times10^8$ vg and the low dose was $4.2\times10^7$ vg. After applying the dual AAV encoding AID-BE3.9max+sgRNA1 to MEF cells, cells were cultured for two weeks before analyzing editing outcomes using HTS (FIG. 30D). Treatment of Baringo MEF cells with the high dose of AID-BE3.9max AAV resulted in 57% editing (with 4.6% indels) of pathogenic C·G to wild-type TA at $Tmc1^{Y182C/Y182C}$ in unsorted cells. Treatment of the MEF cells with the low dose of AID-BE3.9max AAV resulted in 5-10% editing (FIG. 30D). Given the high editing efficiency from high-dose AAV treatment, without sorting for AAV-infected cells, dual AID-BE3.9max+sgRNA1 was used for subsequent in vivo experiments.

Off-Target Analysis of Tmc1 Base Editing

Figure 31A:
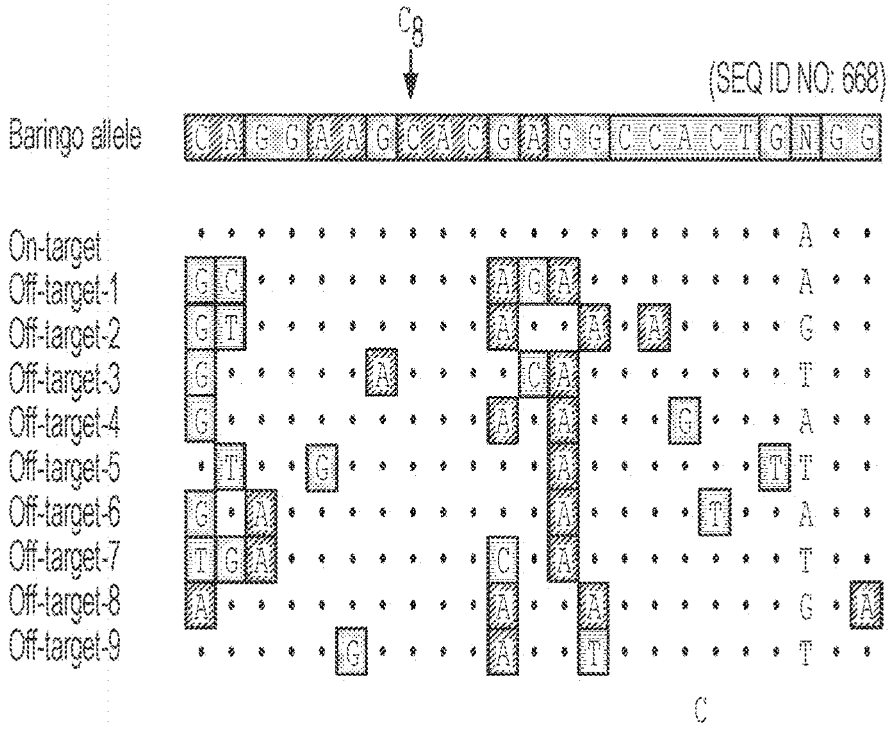
FIGS. 31A-31F show in vivo base editing of $Tmc1^{Y182C/Y182C}$ in Baringo mice, in vitro off-target analysis for sgRNA1, and in vivo analysis of hair-cell stereocilia bundle morphology.

Next, base editing at off-target genomic loci bound by the Cas9:sgRNA1 complex was investigated. Previous reports using unbiased genome-wide off-target detection methods for nucleobase editors have observed that off-target substrates of nucleobase editors are generally a subset of off-targets for the corresponding Cas9 nuclease. CIRCLE-seq, a current unbiased, sensitive, cell-free off-target detection protocol, was used to identify potential off-target editing sites associated with Cas9 and sgRNA1. Genomic DNA was extracted and fragmented from Baringo MEFs, the ~500-bp DNA fragments were ligated into circles, and Cas9 was incubated with sgRNA1. After Cas9 incubation, the cut circles were ligated to adaptors and identified the location of DNA cleavage events by HTS (FIG. 31A). This process applied to sgRNA1 resulted in the identification of 28 candidate off-target sites with notable CIRCLE-seq signals (>10 reads).

Figure 31B:
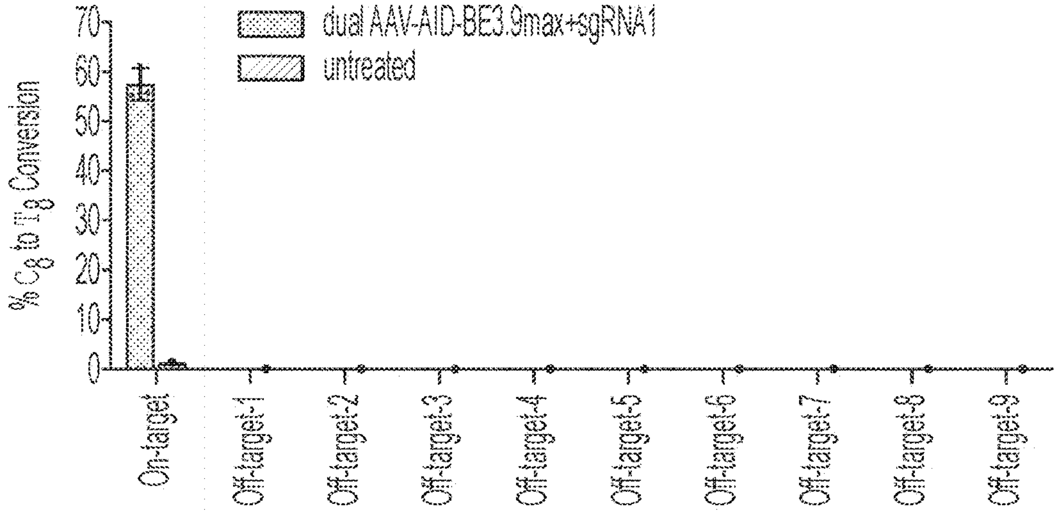
Figure 36:
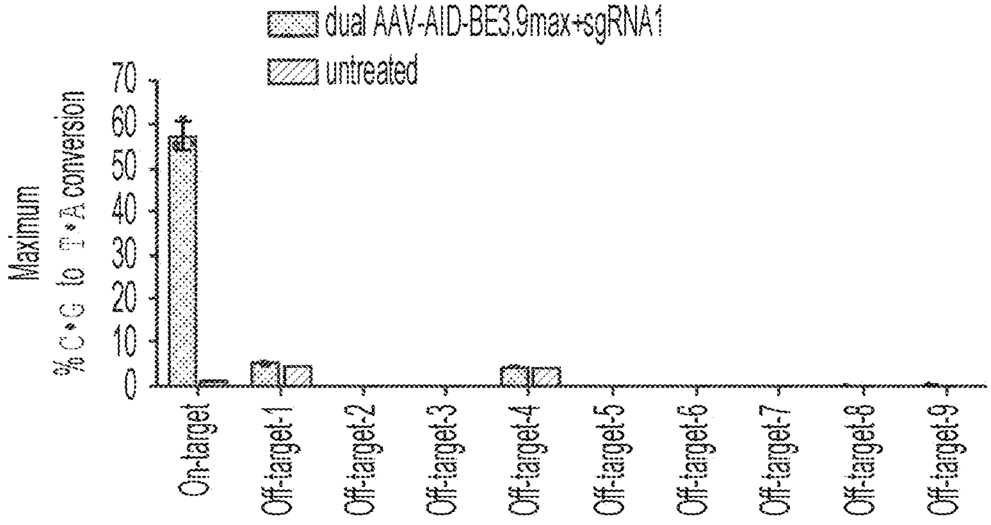
FIG. 36 shows base editing at on-target and off-target genomic DNA sites identified by CIRCLE-seq using Cas9+ sgRNA1. Off-target editing analysis in MEF cells treated with dual AAV encoding AID-BE3.9max+sgRNA1. The top ten sites identified by CIRCLE-seq (the on-target locus and the top nine off-target loci) were sequenced by HTS. The maximum % C·G-to-T·A conversion at any position in the protospacer is shown. No off-target site showed editing levels (red) that were significantly ($p<0.1$) different than the maximum % C·G-to-T·A of the untreated control (blue). Dots and bars represent biological replicates and mean±SEM (n=3 for AAV-treated samples and n=1 for the untreated samples).

Then, amplicon sequencing was performed to measure base editing at the ten genomic sites with the largest number of CIRCLE-seq reads, including the on-target site and the top nine off-target sites (FIG. 31A). The on-target base editing efficiency that was observed for the Baringo allele (from Baringo MEF cells transduced with AAV in vitro) was 57% (FIG. 31B). HTS of the candidate off-target amplicons revealed no off-target editing at any protospacer position (FIG. 31B) above that of an untreated control sample (≤0.1% mutation frequency above the untreated control) at any of the nine tested off-target sites tested (FIG. 31B and FIG. 36). Collectively, these data suggest that base editing of $Tmc1^{Y182C/Y182C}$ by AAV-delivered AID-BE3.9max and sgRNA1 occurs efficiently and is not accompanied by substantial editing at candidate off-target sites identified by CIRCLE-seq.

Figure 37A:
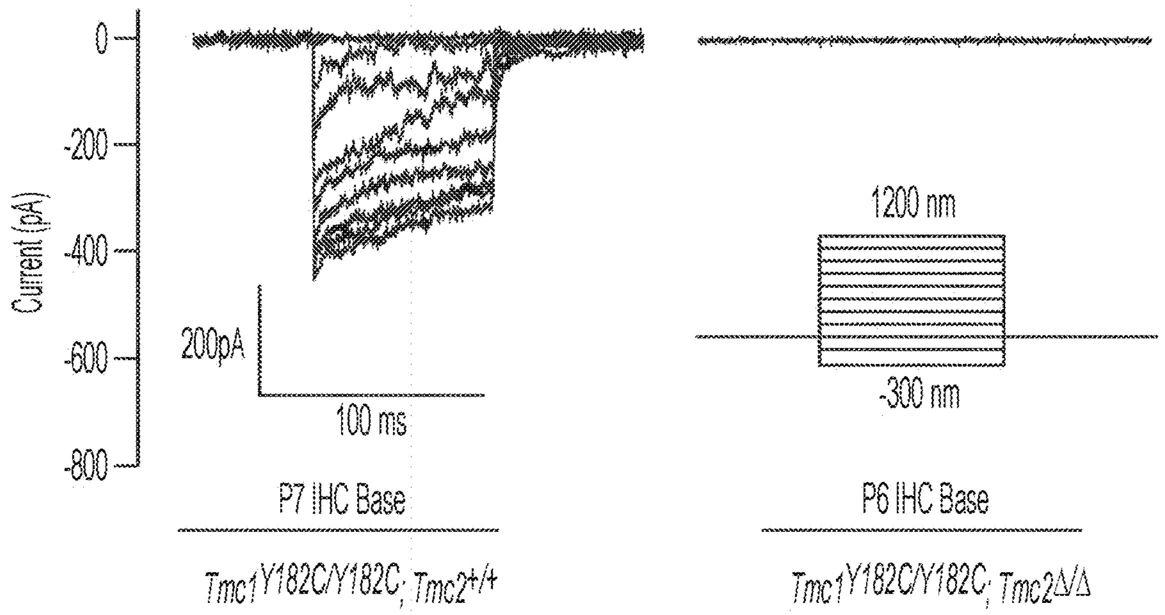
FIGS. 37A-37B show the transduction currents from IHCs and OHCs of Tmc1$^{Y182C/Y182}$; Tmc2$^{+/+}$ and Tmc1$^{Y182C/Y182C}$; Tmc2$^{\Delta/\Delta}$ mice at different time points.
Figure 37B:
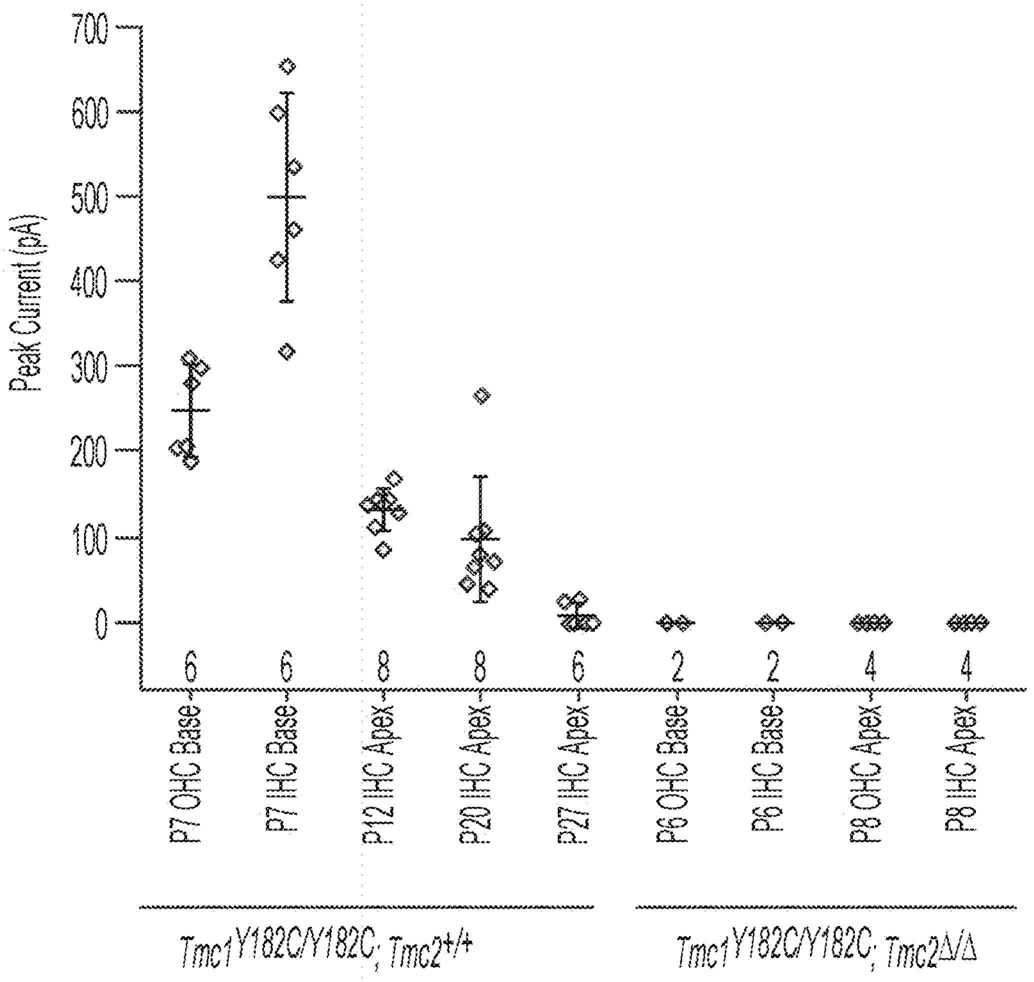

Characterizing Sensory Transduction Currents in $Tmc1^{Y182C/Y182C}$; $Tmc2^{\Delta/\Delta}$ mice While the Tmc1 Y182C mutation is known to cause deafness in Baringo ($Tmc1^{Y182C/Y182C}$; $Tmc2^{+/+}$) mice by 4 weeks of age, the consequence of this mutation on hair cell function has not been previously reported. To determine the effect of the Baringo mutation on sensory transduction currents, the cochlea from Baringo mice was dissected at P8 and recorded currents from the sensory hair cells on the same day of dissection. Robust hair-cell current amplitudes were observed (FIGS. 37A-37B).

Based on previous reports, it was hypothesized that the robust currents in P8 mice were the result of transient expression of Tmc2, which encodes transmembrane channel-like 2 and is redundant with Tmc1 in neonatal mice (P8 or younger). To isolate the consequences of the Y182C substitution on transduction current, Baringo mice were crossed with Tmc2 knockout mice to generate $Tmc1^{Y182C/Y182C}$; $Tmc2^{\Delta/\Delta}$ mice. Hair cells from $Tmc1^{Y182C/Y182C}$; $Tmc2^{\Delta/\Delta}$ mice lacked sensory transduction currents entirely (FIGS. 37A-37B), even during the first postnatal week (P7-8). Collectively, these findings indicate that the Baringo mutation results in a complete loss of TMC1 function. It was concluded that after early postnatal expression of Tmc2 has declined to near zero, the loss of sensory transduction in mature hair cells due to the c.A545G point mutation is the proximal cause of deafness in Baringo mice. These results also suggest that successful base editing of the $Tmc1^{Y182C/Y182C}$ mutation might restore hair-cell sensory transduction and perhaps auditory function.

Tmc1 Base Editing In Vivo

Figure 31C:
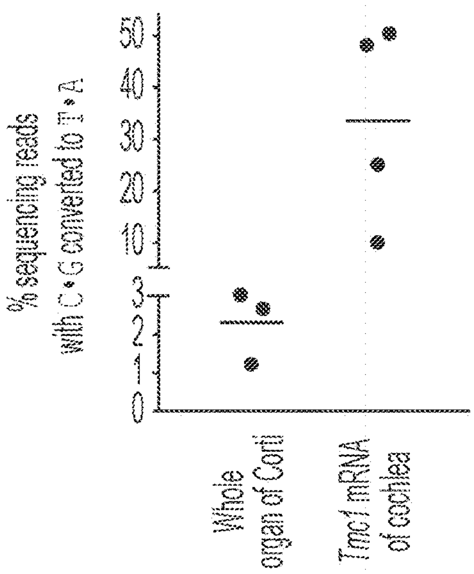

After establishing that AAV-mediated base editing can directly correct the $Tmc1^{Y182C/Y182C}$ mutation in cultured Baringo MEF cells (FIG. 30), and that hair cells from $Tmc1^{Y182C/Y182C}$; $Tmc2^{\Delta/\Delta}$ mice lack sensory transduction, the ability of intracochlear injection of dual AAV encoding AID-BE3.9max+sgRNA1 to correct DNA encoding $Tmc1^{Y182C/Y182C}$ was tested. The injection was performed at P1 and the organ of Corti (the part of the cochlea containing hair cells) was extracted from bulk cochlear tissue of treated Baringo ($Tmc1^{Y182C/Y182C}$; $Tmc2^{+/+}$) mice at P14. DNA from cochlear tissue of injected Baringo mice was sequenced, and base editing was observed at the Tmc1 locus in the organ of Corti from all three treated mice examined (FIG. 31C). Even though the fraction of hair cells in the dissected organ of Corti is estimated to be less than 2% of total cells harvested for DNA sequencing, the whole organ of Corti from treated mice contained the desired base edit in Tmc1 at an average frequency of 2.3±0.4% (FIG. 31C). Since Anc80 AAV is known to preferentially target IHC, 2.3% editing in the entire organ of Corti is consistent with substantial base editing of IHCs.

To more directly assess the base editing efficiency of hair cells within organ of Corti samples, cochlear Tmc1 mRNA of treated mice was sequenced by reverse transcription of total mRNA and amplicon sequencing using primers specific to Tmc1. Given that Tmc1 in the cochlea is only expressed among hair cells, base-edited Tmc1 cDNA observed in the cochlea likely reflects base editing of hair cells. Indeed, 10 to 51% editing efficiency of Tmc1 mRNA was observed, which is 5- to 25-fold higher than DNA editing levels measured in bulk organ of Corti tissue (FIG. 31C). Together, these observations confirm successful in vivo base editing of the Tmc1 locus from treatment with dual AAV.

Figure 38A:
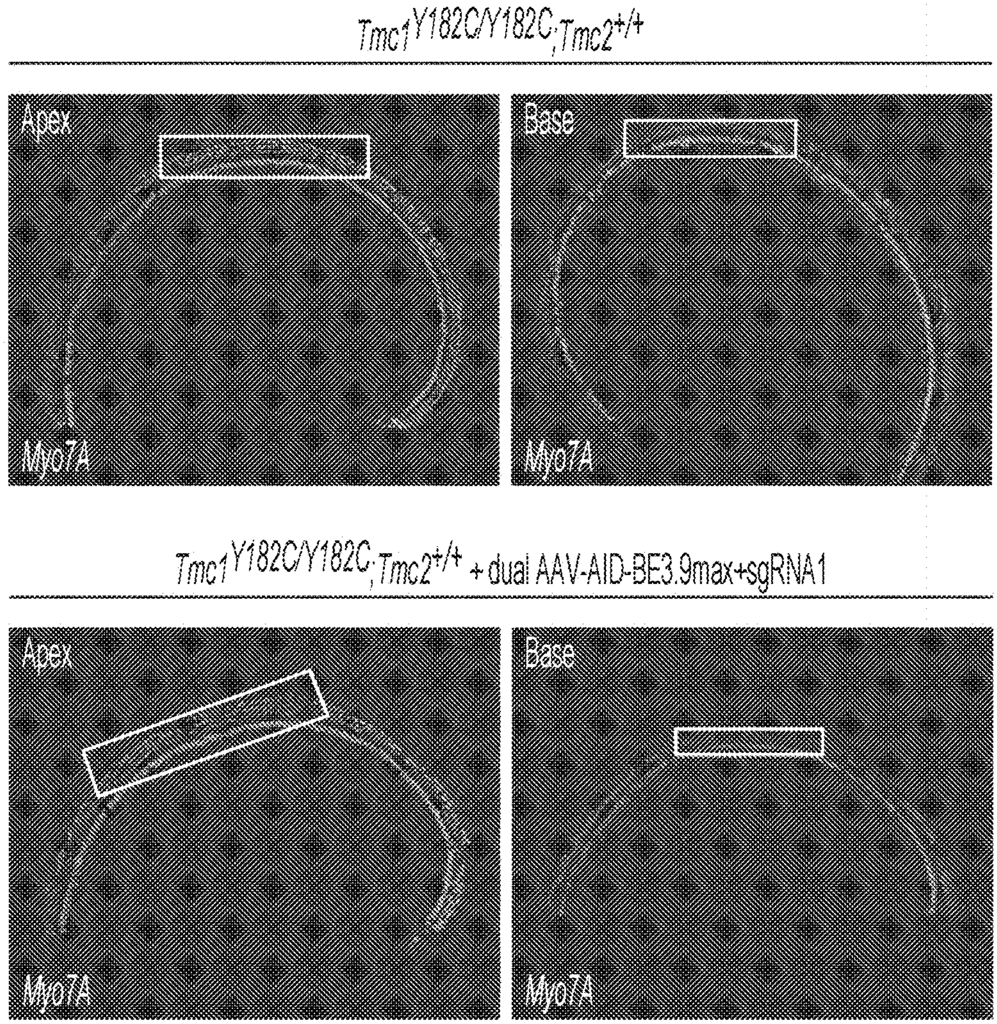
FIG. 38A-38C show the hair cell morphology in the organ of *Corti* from Tmc1$^{Y182C/Y182C}$; Tmc2$^{+/+}$ mice with and without treatment with dual AAV-AID-BE3.9max+ sgRNA1.
Figure 38B:
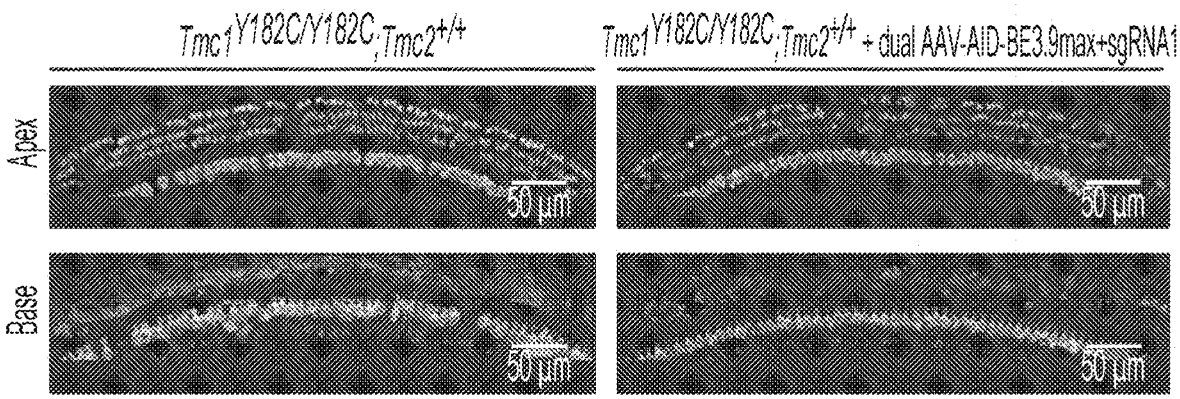
Figure 38C:
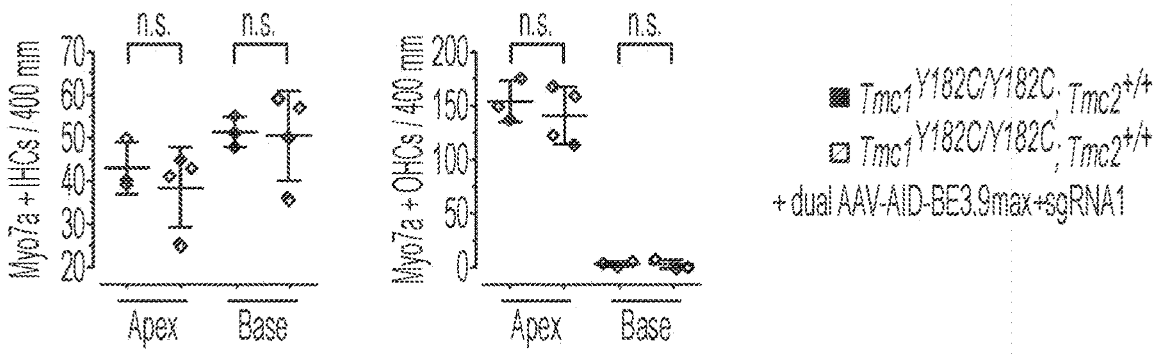

AAV-Mediated In Vivo Base Editing Preserves Inner Hair Cell Stereocilia Morphology Inner and outer hair cells of Baringo mice begin to die around four weeks of age, progressing from the base of the cochlea toward the apex. To investigate the ability of AAV delivered AID-BE3.9max+sgRNA1 to preserve hair cells and hair bundle morphology, Baringo mice were injected at P1, euthanized at P28, and inner ear was excised tissue for histological examination. No overt evidence of inflammation or tissue damage was observed in any of the injected ears. Cochleas were harvested and the entire organ of Corti was dissected, mounted and stained. Given the lack of high-quality anti-TMC1 antibody to visualize TMC1 directly, an anti-Myo7A antibody stain was used to label surviving hair cells. Confocal microscopy analysis of the immunostained organ of Corti tissue revealed no significant differences in overall OHC or IHC survival between untreated and treated Baringo mice (FIGS. 38A-38C). Both groups had significant loss of OHCs, especially in the basal region of the cochlea where almost no surviving OHCs were observed. The IHCs of both groups appeared, by confocal microscopy, to be mostly intact in both apical and basal turns of the cochlea, consistent with prior characterization of Baringo mice.

Figure 31D:
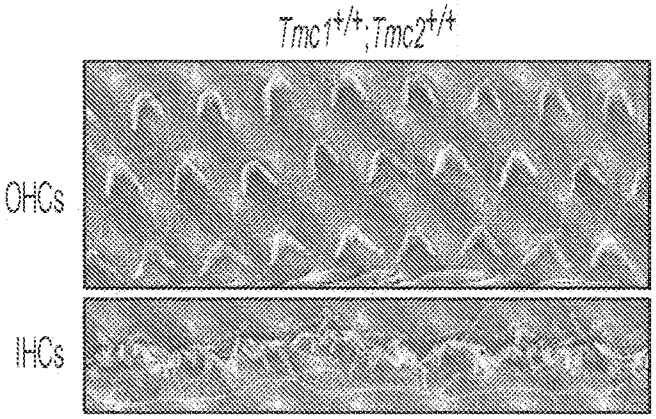
Figure 31E:
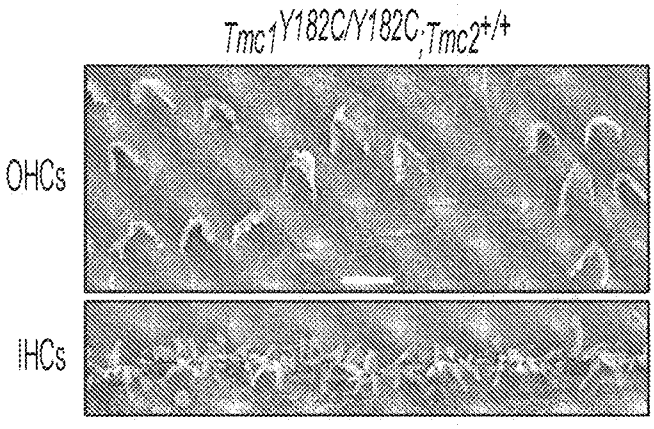
Figure 31F:
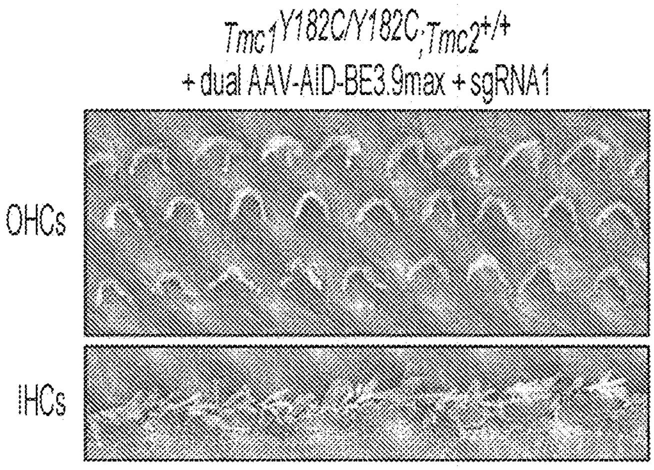
Figure 39A:
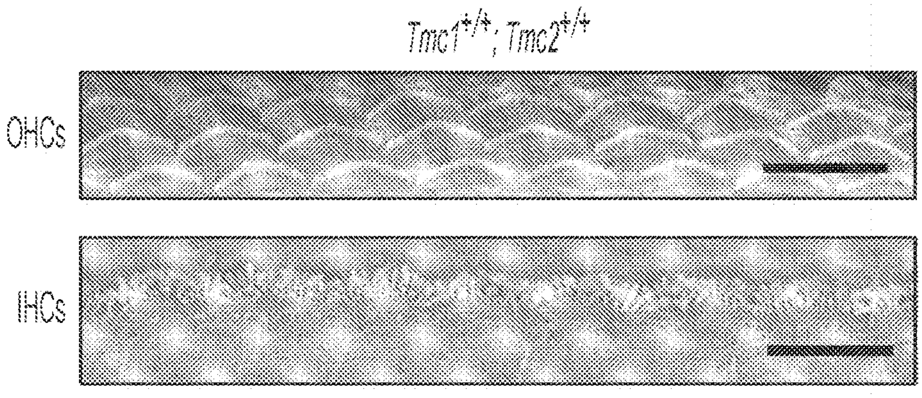
FIGS. 39A-39C show the hair bundle morphology in the basal turn of the organ of Corti from Tmc1$^{Y182C/Y182C}$; Tmc2$^{+/+}$ mice with and without treatment with dual AAV-AID-BE3.9max+sgRNA1. Representative scanning electron microscopy images (basal part) of the organ of Corti are shown from wild-type Tmc1$^{Y182C/Y182C}$; Tmc2$^{+/+}$ mice (FIG. 39A), Tmc1$^{Y182C/Y182C}$Tmc2$^{+/+}$ untreated mice (FIG. 39B), and Tmc1$^{Y182C/Y182C}$; Tmc2$^{+/+}$ mice treated with dual AAV-AID-BE3.9max+sgRNA1 (FIG. 39C). The apical and basal regions of organ of Corti were imaged at 4 weeks. Scale bar, 10 μm.
Figure 39B:
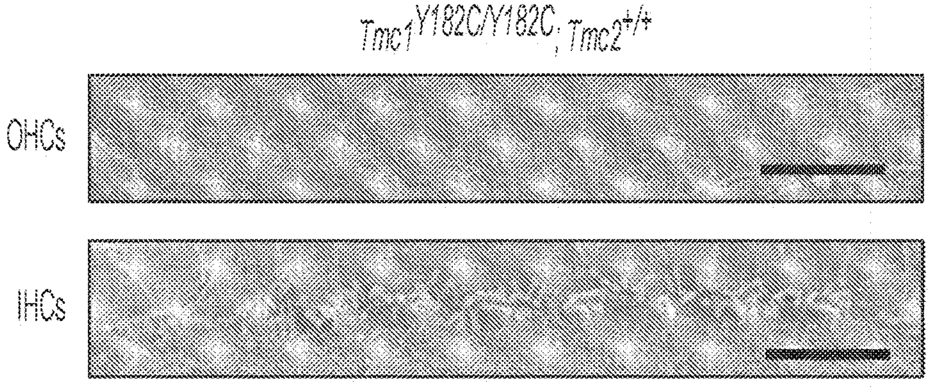
Figure 39C:
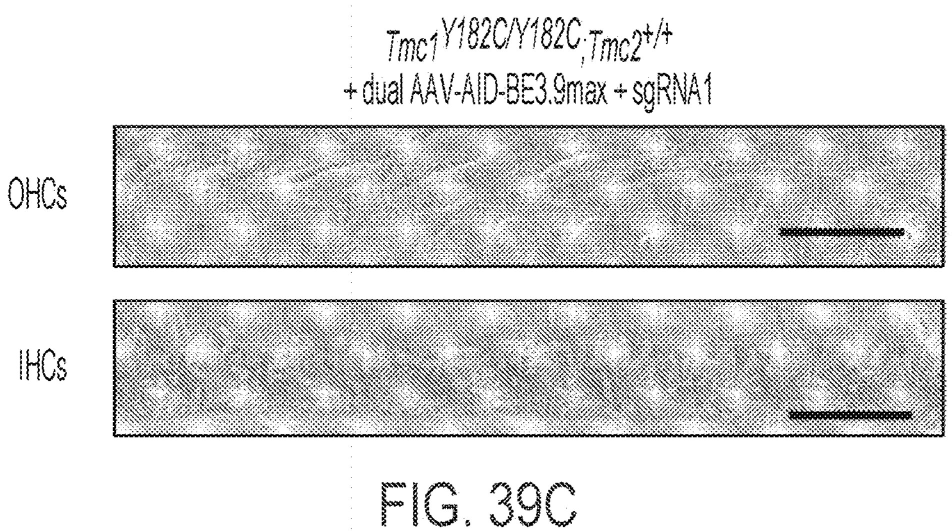

Hair bundle morphology was observed using scanning electron microscopy (SEM). High resolution SEM images revealed striking morphological differences between treated and untreated Baringo hair bundles, particularly in the cochlear apex. Baringo mice injected with AAV-AID- BE3.9max+sgRNA1 had both IHC and OHC bundles from the apical end of the cochlea with morphologies more similar to those of wild-type mice than untreated Baringo mice (FIGS. 31D-31F). At the basal end of cochlea from treated Baringo mice, IHC, but not OHC hair bundles showed preserved morphologies compared to untreated Baringo mice (FIGS. 39A-39C). These morphological differences suggest that treatment with AID-BE3.9max+sgRNA1 promotes preservation of normal hair bundle morphology, which is otherwise disrupted in untreated Baringo mice. Since normal hair bundle morphology is a prerequisite for normal hair cell function, these findings raise the possibility that preservation of hair bundles from base editing with AID-BE3.9max+sgRNA1 might render Baringo hair cells functional.

Base Editing Tmc1 In Vivo Restores Hair-Cell Sensory Transduction Current

After establishing that AAV-mediated base editing can directly correct the $Tmc1^{Y182C/Y182C}$ mutation in cultured Baringo MEF cells (FIGS. 30A-30D), and that hair cells from $Tmc1^{Y182C/Y182C}$; $Tmc2^{\Delta/\Delta}$ mice lack sensory transduction, whether intracochlear injection of dual AAV encoding AID-BE3.9max+sgRNA1 could rescue sensory transduction currents in auditory hair cells of $Tmc1^{Y182C/Y182C}$; $Tmc2^{\Delta/\Delta}$ mice was next tested. To identify hair cells with functional sensory transduction, an uptake of FM1-43, a styryl dye that enters hair cells through sensory transduction channels was visualized. Hair cells lacking functional TMC1 and TMC2 proteins do not internalize FM1-43, whereas cells with functional sensory transduction channels readily take up FM1-43.

Figure 32A:
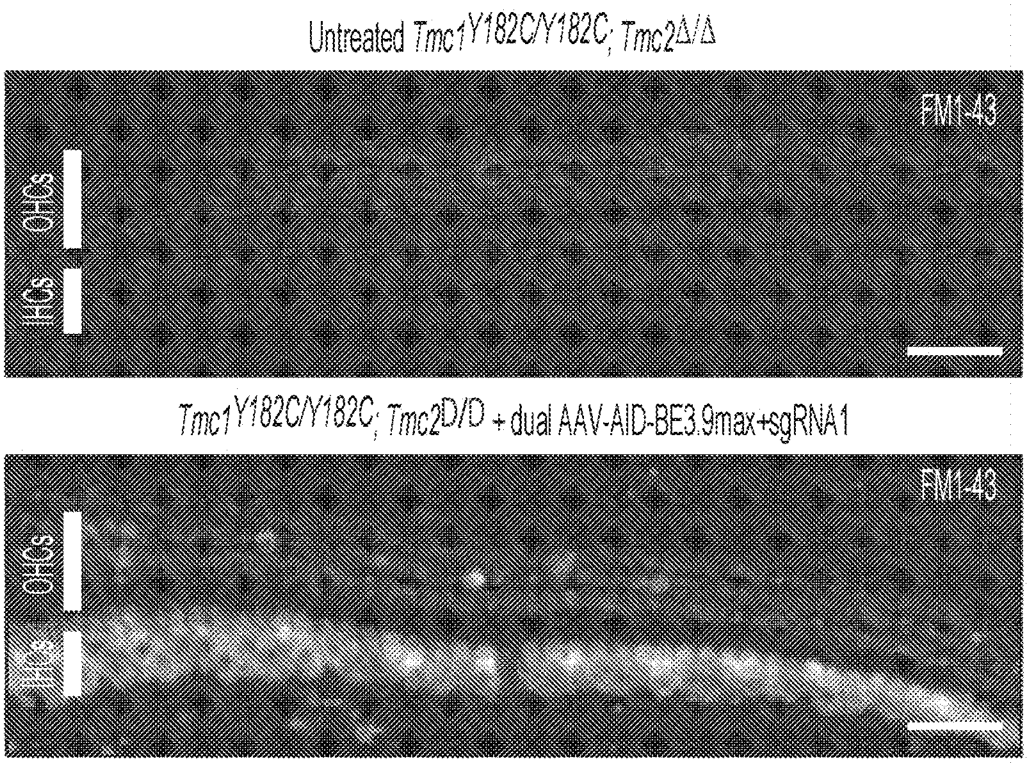
FIGS. 32A-32C show that the inner ear injection of dual AAV encoding AID-BE3.9max+sgRNA1 restores sensory transduction in Tmc1$^{Y182C/Y182C}$; Tmc2$^{\Delta/\Delta}$ inner hair cells.
Figure 32B:
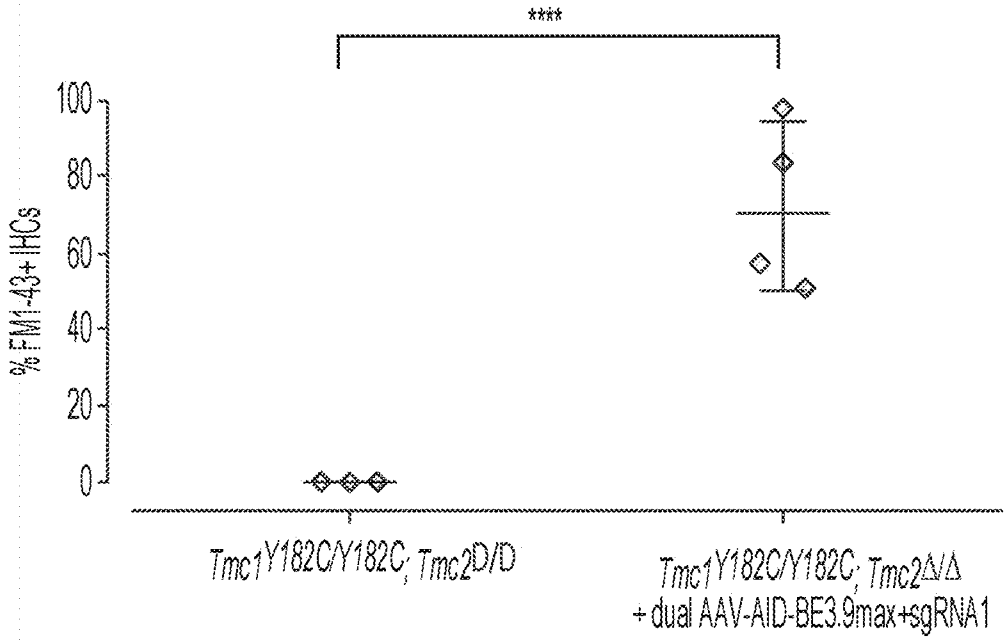

A FM1-43 uptake was imaged in two groups of $Tmc1^{Y182C/Y182C}$; $Tmc2^{\Delta/\Delta}$ mice: an untreated control group, and a treated group that received an intracochlear injection of 1 μL of $7.2\times10^8$ vg total of dual AAV encoding AID-BE3.9max+sgRNA1 at P1. After 5-7 days of treatment, the cochlea from both groups of mice was dissected ($Tmc1^{Y182C/Y182C}$; $Tmc2^{\Delta/\Delta}$), the cochleas were cultured in vitro for 7-10 days, and FM1-43 was applied. No FM1-43 uptake in the IHCs or OHCs of untreated mice was observed, but robust FM1-43 uptake among 75±10% (n=4 cochleas) of IHCs of treated mice, and very little FM1-43 uptake in OHCs of treated mice was observed (FIGS. 32A-32B). These results suggest restoration of function in IHCs of base-editor treated mice, but not in untreated mice.

Figure 32C:
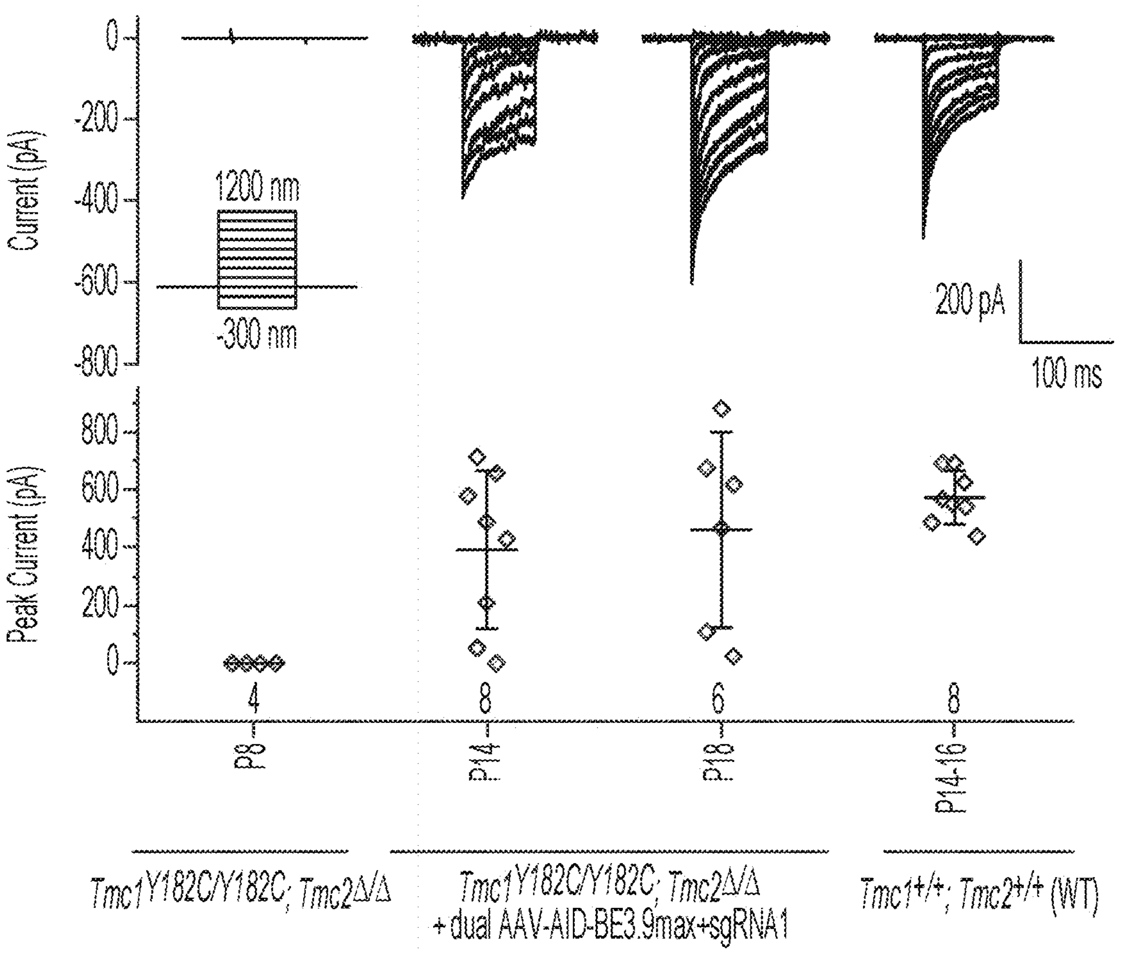

To directly assess the effect of in vivo base editing on IHC function, sensory transduction currents from IHCs were recorded. $3.1\times10^9$ vg of each AAV encoding AID-BE3.9max+sgRNA1 was injected into the inner ear of P1 $Tmc1^{Y182C/R182C}$; $tmc2^{\Delta/\Delta}$ mice and the organ of Corti was extracted at P5. Extracted P5 organ of Corti tissue was maintained in culture and incubated for an additional 7-10 days before cellular recording. In agreement with the FM1-43 uptake data (FIGS. 32A-32B), IHCs of mice injected with dual AAV encoding AID-BE3.9max:sgRNA1 displayed robust sensory transduction at both time points tested (P14 and P18) (FIG. 32C). Indeed, nine of fourteen IHCs from treated mice exhibited current amplitudes that were indistinguishable from those of wild-type ($Tmc1^{Y182C/Y182C}$; $Tmc2^{+/+}$) mice. In contrast, untreated $Tmc1^{Y182C/Y182}$C; $Tmc2^{\Delta/\Delta}$ mice showed no transduction currents in any of the four tested IHCs at P8 (FIG. 32C, leftmost data).

Collectively, these results demonstrate that in vivo delivery of dual AAVs encoding AID-BE3.9max and sgRNA1 restored wild-type (FIG. 32C, in black) sensory transduction in a substantial fraction of IHCs from treated $Tmc1^{Y182C/Y182C}$; $Tmc2^{\Delta/\Delta}$ mice, which without treatment show no sensory transduction currents.

In Vivo Base Editing Rescues Auditory Function

The rescue of IHC morphology and restoration of IHC sensory transduction in base-edited Baringo mice suggests that these mice may exhibit rescued cochlear function compared to untreated Baringo mice, which are profoundly deaf at 4 weeks of age. To test this possibility, auditory brainstem responses (ABRs) were measured at P30 in untreated Baringo mice and Baringo ($Tmc1^{Y182C/Y182C}$; $Tmc2^{+/+}$) mice injected at P1.

Figure 33A:
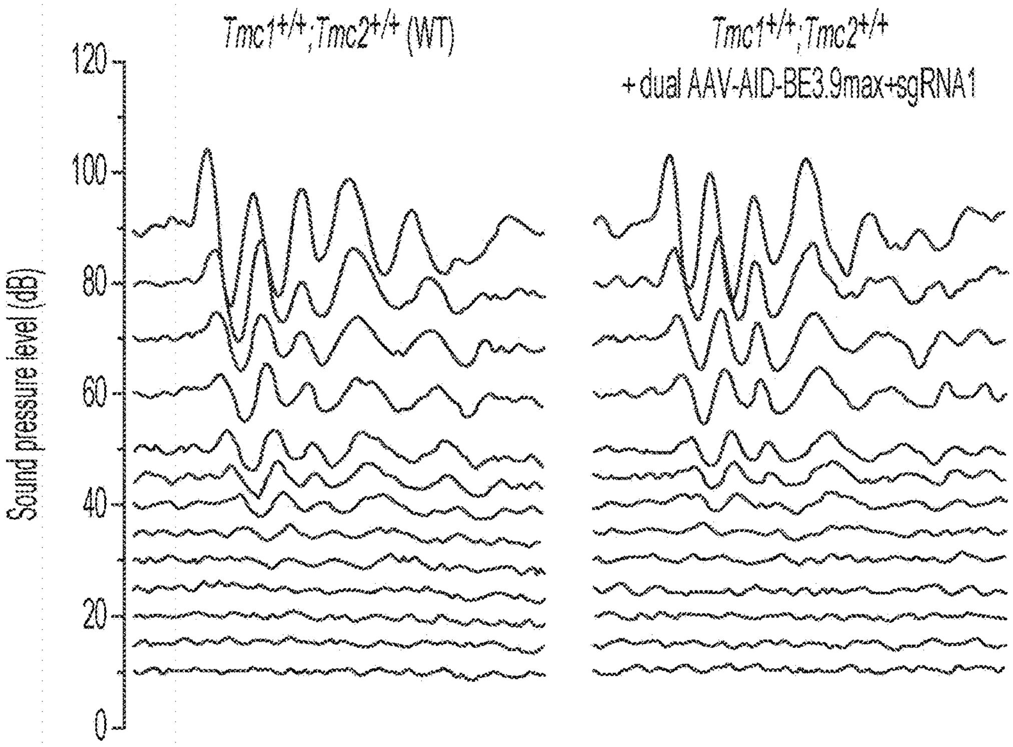
FIGS. 33A-33D show that dual AAV nucleobase editor treatment partially restores auditory function in Baringo (Tmc1$^{Y182C/Y182C}$; Tmc2$^{\Delta/\Delta}$) mice.
Figure 33B:
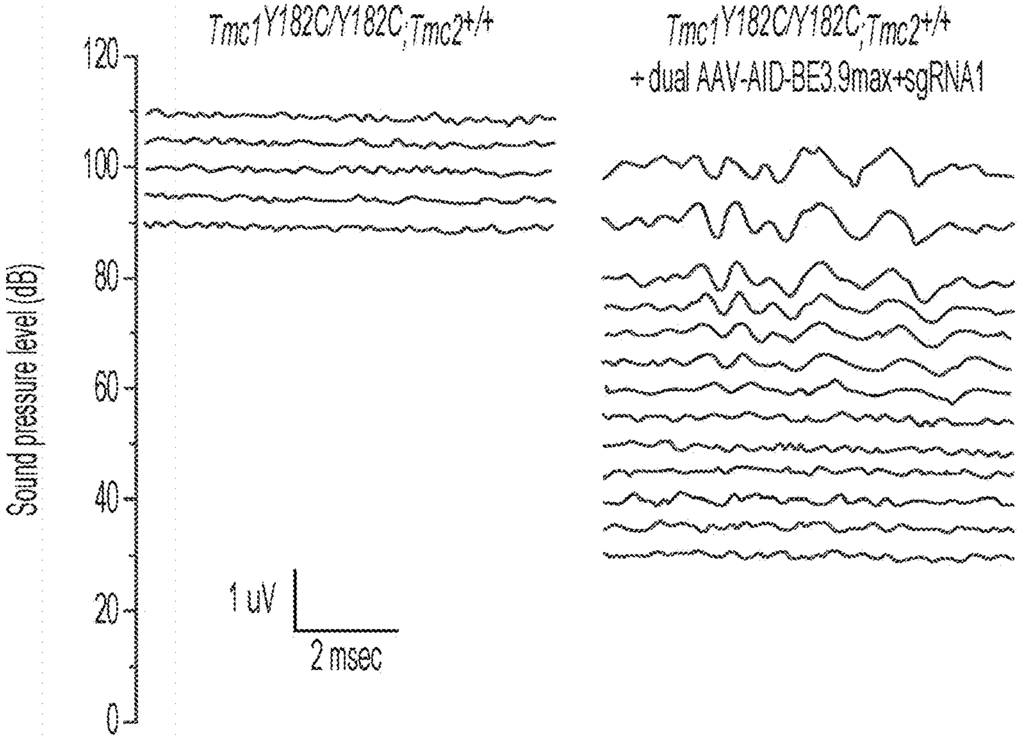

The ABR threshold is the lowest decibel (dB) level needed to generate identifiable auditory brainstem waveforms. Representative families of ABR waveforms recorded in response to 5.6-kHz tone bursts of varying sound intensity are illustrated in FIGS. 33A-33B. The waveform families in FIGS. 33A-33B were selected to illustrate representative responses of wild-type ($Tmc1^{182C/Y182C}$; $Tmc2^{+/+}$) control mice with or without treatment with dual AAV encoding AID-BE3.9max+sgRNA1 intracochlear injection ($7.2\times10^8$ vg total viral genomes) (FIG. 33A), and Baringo mice with or without the same AAV treatment. The ABR threshold for a 5.6 kHz tone burst for wild-type ($Tmc1^{Y182C/Y182C}$; $Tmc2^{+/+}$) control groups (injected or uninjected) was 30 dB (FIG. 33A; lighter-shaded lines at 30 dB). In contrast, untreated Baringo mice showed no detectable ABR thresholds at the maximum sound level tested (110 dB), indicating profound deafness (FIG. 33B). Importantly, treated Baringo mice had ABR thresholds as low as 60 dB (FIG. 33B), representing at least 50 dB of improvement compared to untreated Baringo mice.

Figure 33C:
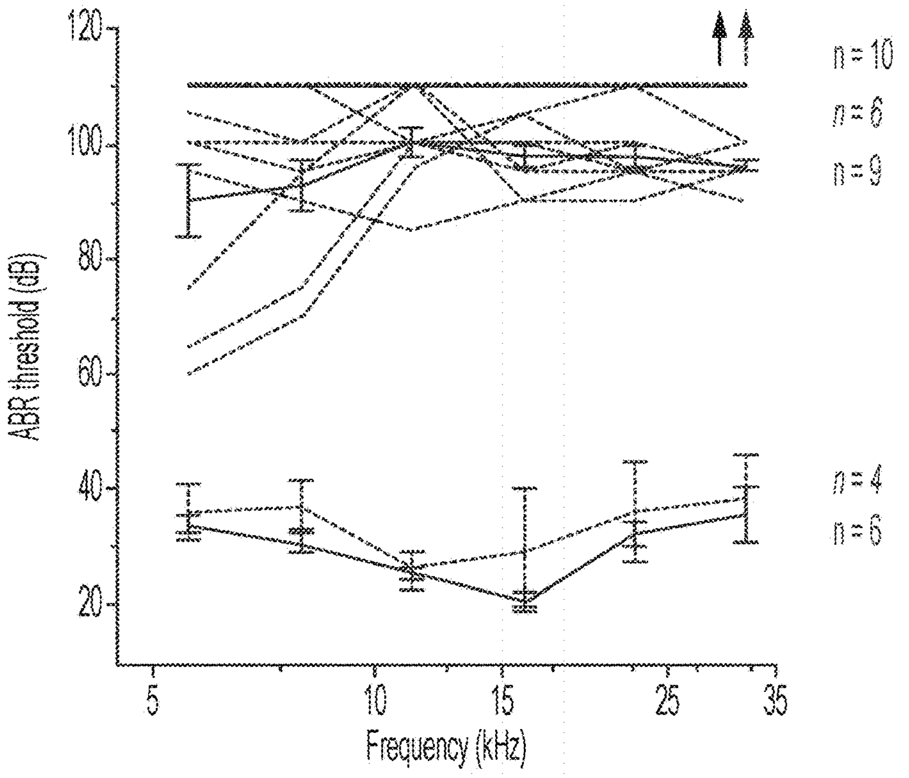

A summary plot of ABR thresholds as a function of frequency for all four groups are illustrated in FIG. 33C. Of the ten untreated Baringo ($Tmc1^{Y182C/Y182C}$; $Tmc2^{+/+}$) mice, none showed detectable auditory function across all frequencies tested, even at 110 dB. In contrast, of 15 Baringo ($Tmc1^{Y182C/Y182C}$; $Tmc2^{+/+}$) mice injected with AAV encoding AID-BE3.9max+sgRNA1, nine showed rescue of some auditory function, with ABR thresholds at 5.6 kHz and 8.0 kHz averaging ~90 dB, and ABR thresholds at higher frequencies 11.3 kHz, 16.0 kHz, 22.6 kHz, 32.0 kHz averaging ~95-100 dB (FIG. 33C). Thus, across all treated Baringo mice, AAV-delivered AID-BE3.9max+sgRNA1 improved ABR thresholds by at least 5 to at least 50 dB across all frequencies tested.

Figure 33D:
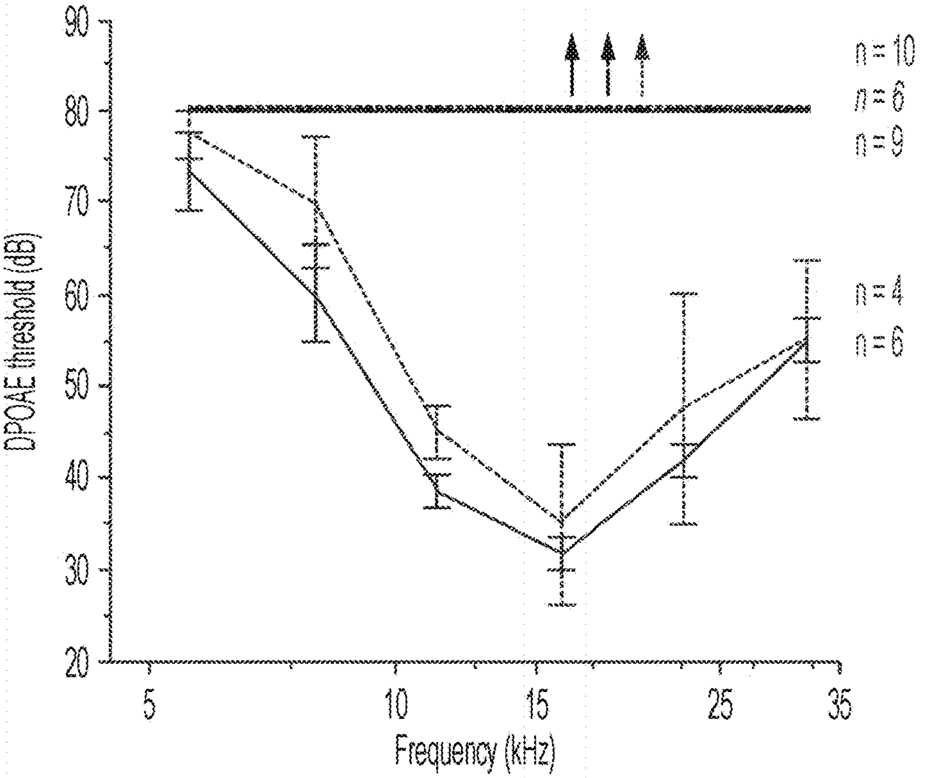

The function of outer hair cells (OHCs) using distortion product otoacoustic emissions (DPOAE) were also measured (FIG. 33D). DPOAE analysis revealed that none of the 15 treated Baringo mice showed recovery of DPOAEs relative to untreated mice. The lack of DPOAEs suggest a lack of OHC recovery, consistent with the lack of functional recovery of OHCs and the lack of OHC bundles in the base (FIGS. 39A-39C). This lack of DPOAE recovery likely resulted from lower viral transduction efficiency of Anc80 in OHCs, as previously reported or the lower efficiency of the Cbh promoter in OHCs as noted above.

Finally, to rule out any possible adverse effects of the injection procedure, AAV transduction, or post-splicing intein peptide in the ABR or DPOAE tests, AAV encoding AID-BE3.9max+sgRNA1 was injected into the inner ears of four wild-type mice (FIGS. 33C-33D; lighter-shaded lines, n=4). ABR and DPOAE thresholds of treated wild-type mice were not significantly different (each frequency has a p-value >0.1) than those of the untreated wild-type mice (FIGS. 33C-33D; blue lines), confirming that the injection technique, viral capsid, AID-BE3.9max, and sgRNA1 did not have any apparent effect on auditory function in the absence of the $Tmc1^{Y182C/Y182C}$ mutation.

Collectively, these results demonstrate that AAV-mediated base editing of $Tmc1^{Y182C/Y182C}$ improves auditory function in Baringo mice and represent the first in vivo rescue of a recessive sensory impairment disease by base editing.

Discussion

Recessive loss-of-function mutations cause most known genetic hearing loss diseases. As described herein, base editing was used in vitro and in vivo to correct a point mutation in transmembrane channel-like 1 (Tmc1) that causes profound deafness. Base editing fully restored hair-cell function in a subset of cells, preserved hair-cell morphology, and rescued auditory sensitivity especially to low frequencies in a mouse model of human recessive deafness. These results represent the first correction (rather than disruption) of a pathogenic mutation in the inner ear resulting in improved auditory function and demonstrate the promise of base editing to directly correct loss-of-function recessive mutations. Among 108 recorded human Tmc1 mutations that likely cause genetic hearing loss, can, in principle, be corrected with cytosine or adenine nucleobase editors (Table 5). The focus of these Examples was on a recessive loss-of-function mutation; however, the nucleobase editors described herein may also be used to correct dominant mutations.

In vivo delivery of AAV encoding an optimized nucleobase editor and guide RNA resulted in up to 50% base editing efficiency in restoring the wild-type coding sequence of Tmc1 in hair cells (HCs) in Baringo mice. Importantly, base-edited hair cells were mostly IHCs, which upon treatment resisted morphological degeneration normally seen in untreated Baringo mice. The treated mice also exhibited normal sensory transduction currents, unlike IHCs of untreated Baringo mice. Treated mice exhibited ABR thresholds at 5.6 kHz improved by at least 10-50 dB compared to the undetectable ABR thresholds observed in untreated Baringo mice. Given that the untreated Baringo mouse model used herein has no detectable auditory function at 4 weeks of age, this level of auditory function rescue represents a major improvement. For a patient with a similar loss-of-function TMC1 mutation, a corresponding improvement would represent the difference between hearing nothing at all to being able to detect salient auditory cues in the environment, such as alarms, ringing phones, or sirens from an emergency vehicle. Moreover, this level of auditory function could be supplemented with hearing aids that extend auditory functional recovery.

To rescue auditory sensitivity over a greater range of frequencies, it will be necessary to develop a similarly efficient base editing delivery strategy for editing outer hair cells (OHCs). The development of viral capsids or promoters capable of supporting dual OHC transduction with higher efficiency thus holds promise to further improve outcomes of correcting mutations that cause genetic hearing loss. In addition, the onset of degeneration at the basal (high-frequency) end of the cochlea is thought to occur earlier than at the apical (low-frequency) end, suggesting the importance of treating as early as possible to rescue high-frequency auditory function.

Materials and Methods

Study Design

The methods described herein aimed to use base editing in the post-natal mouse inner ear to correct a recessive loss-of-function point mutation that causes congenital deafness, resulting in the rescue of hair-cell sensory transduction, hair-cell morphology, and auditory function. nucleobase editor variants that correct a recessive mutation in Tmc1 were identified in cultured cells and in vivo. AAV vectors were used to deliver nucleobase editors in vitro and in vivo, and editing outcomes were evaluated using high-throughput sequencing, quantitative RT-PCR, immunolocalization and confocal microscopy, scanning electron microscopy, imaging of FM1-43 uptake, single-cell current transduction recording, histology and imaging of whole cochleas, and measurement of ABR and DPOAE thresholds. Left ears were injected and right ears were used as uninjected controls. Each experiment was replicated as indicated by n values in the figure legends. All experiments with mice and viral vectors were approved by the Institutional Animal Care and Use Committee (Protocols #17-03-3396R and 18-01-3610R) at Boston Children's Hospital and the Institutional Biosafety Committee.

Mice

Wild-type mice were C57BL/6J (Jackson Laboratories). Two genotypes of mutant mice were used: $Tmc1^{Y182C/Y182C}$; $Tmc2^{+/+}$ and $Tmc1^{Y182C/Y182C}$; $Tmc2^{\Delta/\Delta}$. The Tmc1p.Y182C "Baringo" mice were obtained from Murdoch Children's Research Institute (The Royal Children's Hospital, Australia). Mice with genotype $Tmc1^{Y182C/Y182C}$; $Tmc2^{\Delta/\Delta}$ were obtained by crossing of $Tmc1^{\Delta/\Delta}$; $Tmc2^{\Delta/\Delta}$ with $Tmc1^{Y182C/Y182C}$; $Tmc2^{+/+}$. Mice that carried mutant alleles of Tmc1 and Tmc2 were on C57BL/6J or BALB/c backgrounds as described previously. Wild-type control mice were C57BL/6J (Jackson Laboratories). All procedures met the NIH guidelines for the care and use of laboratory animals and were approved by the Institutional Animal Care and Use Committees at Boston Children's Hospital (Protocols #17-03-3396R and 18-01-3610R). Mice ages P0-P1 were used for in vivo delivery of viral vectors according to protocols mentioned above. Mice were genotyped using toe clip (before P8) or ear punch (after P8) and PCR was performed as described previously. For all studies, both male and female mice were used in approximately equal proportions.

Baringo ($Tmc1^{Y182C/Y182}$C; $Tmc2^{+/+}$) Mouse Embryonic Fibroblast Cell Generation Baringo females at 3-4 weeks of age were treated with single intra-peritoneal injection of 5 U each of pregnant mare's serum gonadotropin (Prospec) followed by human chorionic gonadotropin (Sigma) after 44-45 hours and paired with Baringo males. The following morning, females were examined for copulatory plugs to confirm matings and marked as 0.5 dpc. At day 13.5 females were sacrificed by $CO_2$ inhalation followed by cervical dislocation. Embryos were harvested in PBS under aseptic conditions. To harvest primary embryonic fibroblasts, each embryo was eviscerated and head was removed. The remaining parts of each embryo were minced to prepare single-cell suspensions and treated with 0.25% Trypsin-EDTA (Gibco) at 37° C. for 10 minutes, followed by centrifugation for 10 minutes. Pellets were resuspended in growth media containing DMEM, 10% FBS, penicillin-streptomycin (100 U/mL) and plated on 15-cm tissue culture plates, then incubated at 37° C. until confluent. The Baringo colony is maintained ad libitum and all animal procedures are approved by the Children's Hospital IACUC in compliance with relevant ethical regulations.

Nucleofection and Viral Infection of Baringo ($Tmc1^{Y182C/Y182C}$; $Tmc2^{+/+}$) MEF Cells MEF cells were cultivated until confluent, then pooled. Replicates were performed on the same day using three separate nucleofections followed by cultivation in separate wells. Each nucleofection contained 400 ng nucleobase editor as a P2A-GFP plasmid and 100 ng guide RNA plasmid. Transfection programs were optimized following manufacturer's instructions (CZ-167, P4 Primary Cell 4D-Nucleofector X Kit, Lonza). Cells were sorted at the MIT FACS core three days after nucleofection and genomic DNA was purified directly after sorting. Next, high-throughput DNA sequencing (HTS) was performed. For AAV infection, each AAV was added to a single well of a 48-well plate. After 2 weeks, the DNA was extracted and analyzed by HTS.

Genomic DNA Purification

Genomic DNA was purified from sorted cells or cochlea tissue using Agencourt DNAdvance kits (Beckman Coulter A48705) following the manufacturer's directions.

RNA Isolation from the Cochlea

RNA isolation was performed with the RNeasy Plus Micro Kit (QIAGEN) according to the manufacturer's instructions. In brief, 250 μL of RLT Plus Buffer (QIAGEN) b-mercaptoethanol was added to each tube with one cochlea in it; tissue was homogenized by pipetting, fast freezing, and vertexing, and transferred into a DNA eliminator column. Subsequent binding and washing steps for RNA isolation using the RNeasy columns were performed according to the manufacturer's instructions. RNA was eluted from the RNeasy column with 45 μL of RNase-free water (QIAGEN). Total RNA was converted into cDNA on the same day.

cDNA Generation for Targeted RNA Amplicon Sequencing cDNA was generated from the isolated RNA using the Prot® Script II First Strand cDNA Synthesis Kit (New England Biolabs) according to the manufacturer's instructions with Oligo-dT primers. Amplification of cDNA for high-throughput sequencing was performed to the top of the linear range (29 cycles) using qPCR as described below. High-throughput sequencing of amplicons was performed as described below. Sequences were aligned to the reference sequence for each RNA, obtained from the NCBI.

CIRCLE-seq

CIRCLE-seq was performed as previously described. PCR amplification before sequencing was conducted using PhusionU polymerase, and products were gel-purified and quantified with a KAPA library quantification kit before loading onto an Illumina MiSeq. Data was processed using the CIRCLE-Seq analysis pipeline with parameters: "read_threshold: 4; window_size: 3; mapq_threshold: 50; start_threshold: 1; gap_threshold: 3; mismatch_threshold: 6; merged_analysis: True". The top ten most common sites based on CIRCLE-seq read count were chosen for PCR amplification and high-throughput sequencing.

High-Throughput DNA Sequencing and Data Analysis

Genomic DNA was amplified by qPCR using Q5 High-Fidelity 2× Master Mix with use of SYBR gold for quantification. To minimize PCR bias, reactions were stopped during the exponential amplification phase. 2 uL of the unpurified gDNA PCR product was used as a template for subsequent barcoding PCR (8 cycles, annealing temperature 61° C.). Pooled barcoding PCR products were gel-extracted (Min-elute columns, Qiagen) and quantified by qPCR (KAPA KK4824). Sequencing of pooled amplicons was performed using an Illumina MiSeq according to the manufacturer's instructions. All oligonucleotide sequences used for gDNA amplification are provided in Table 3.

Initial de-multiplexing and FASTQ generation were performed by bcl2fastq2 running on BaseSpace (Illumina) with the following flags: -ignore-missing-bcls -ignore-missing-filter -ignore-missing-positions -ignore-missing-controls -auto-set-to-zero-barcode-mismatches -find-adapters-with-sliding-window -adapter-stringency 0.9-mask-short-adapter-reads 38-minimum-trimmed-read-length 38. Alignment of fastq files and quantification of editing frequency was performed by CRISPResso2 in batch mode with the following flags: -min_bp_quality_or_N 20-base_editor_output -p 2-w 20-wc -10.

For quantification of conversion to wild-type Tmc1 protein (FIGS. 30A-30D), the percentage of aligned reads around the target site that matched the sequences are given in Table 4, all of which contain the targeted coding mutation with no other non-silent mutations or indels, were summed for each replicate from the CRISPResso2 allele table.

Tissue Preparation

Temporal bones were harvested from mouse pups at P0-P5. Pups were euthanized by rapid decapitation and temporal bones were dissected in MEM (Invitrogen, Carlsbad, CA) supplemented with 10 mM HEPES, 0.05 mg/ml ampicillin, and 0.01 mg/ml ciprofloxacin at pH 7.4. The membranous labyrinth was isolated under a dissection scope, Reissner's membrane was peeled back, and the tectorial membrane and stria vascularis were mechanically removed. Organ of Corti cultures were pinned flatly beneath a pair of thin glass fibers adhered at one end with Sylgard to an 18-mm round glass coverslip. Tissues were either used acutely or kept in culture in presence of 1% Fetal Bovine Serum. Cultures were maintained for 7 to 10 days. For mice older than P10, temporal bones were harvested after euthanizing the animal with inhaled $CO_2$, and cochlear whole mounts were generated.

Electrophysiological Recording

Recordings were performed in standard artificial perilymph solution containing (in mM): 144 NaCl, 0.7 NaH2PO4, 5.8 KCl, 1.3 CaCl2, 0.9 MgCl2, 5.6 D-glucose, and 10 HEPES-NaOH, adjusted to pH 7.4 and 320 mOsmol/kg. Vitamins (1:50) and amino acids (1:100) were added from concentrates (Invitrogen, Carlsbad, CA). Hair cells were viewed from the apical surface using an upright Axioskop FS microscope (Zeiss, Oberkochen, Germany) equipped with a 63× water immersion objective with differential interference contrast optics. Recording pipettes (3-5 MΩ) were pulled from borosilicate capillary glass (Garner Glass, Claremont, CA) and filled with intracellular solution containing (in mM): 135 KCl, 5 EGTA-KOH, 10 HEPES, 2.5 K2ATP, 3.5 MgCl2, 0.1 CaCl2, pH 7.4. Currents were recorded under whole-cell voltage-clamp at a holding potential of −64 mV at room temperature. Data were acquired using an Axopatch 200A (Molecular devices, Palo Alto, CA) filtered at 10 kHz with a low pass Bessel filter, digitized at ≥20 kHz with a 12-bit acquisition board (Digidata 1322) and pClamp 8.2 and 10.5 (Molecular Devices, Palo Alto, CA). Data were analyzed offline with OriginLab software.

Viral Vector Generation

Anc80L65 vectors carrying the split coding sequences of AID-BE3.9max, inteins, sgRNA1, and Cbh promoter (a hybrid form of chicken (3-actin promoter) were generated using a helper virus free system and a double transfection method. All viruses were produced by the Viral Core at Boston Children's Hospital. Titers were calculated by qPCR with ITR primers (LITR-F: GACCTTTGGTCGCCCGGCCT (SEQ ID NO: 481); LITR-R: GAGTTGGCCACTCCCTCTCTGC (SEQ ID NO: 484)) and GFP primers (GFP-F: AGAACGGCATCAAGGTGAAC (SEQ ID NO: 485); GFP-R: GAACTCCAGCAGGACCATGT (SEQ ID NO: 486)). All three vectors were purified using an iodixanol step gradient followed by ion exchange chromatography. Virus aliquots were stored at −80° C. The titer was 6.11×1012 per mL for BE3.9max-AID-N-terminal and 8.26×1012 per mL for C-terminal virus.

FM1-43 Imaging

FM1-43 (Invitrogen) was diluted in extracellular recording solution (5 μM final concentration) and applied to tissues for 10 seconds, then washed three times in extracellular recording solution to remove excess and prevent uptake via endocytosis. After 5 minutes the intracellular FM1-43 was imaged (Zeiss Axioscope FS Plus) using an FM1-43 filter set and epifluorescence light source with a 63× water immersion objective, or by confocal microscopy.

Confocal Microscopy

All injected and non-injected cochleae were harvested after animals were sacrificed by $CO_2$ inhalation. Temporal bones were removed and immersion fixed for 1 hour at room temperature with 4% paraformaldehyde. *Cochleae* were then rinsed in PBS and stored at 4° C. in preparation for dissection and immunohistochemistry. Before dissection, temporal bones were decalcified in 120 mM EDTA for 24 h (for P30). For the subsequent immunohistochemical analysis, tissues were infiltrated with 0.01% Triton X-100 for 30 minutes and blocked in 2.5% normal goat serum (Jackson ImmunoResearch) and 2.5% bovine serum albumin (Jackson ImmunoResearch) diluted in PBS (blocking solution) for 1 h and subsequently stained with a rabbit anti-Myosin VIIa primary antibody (*Proteus* Biosciences, Product #: 25-6790, 1:500 dilution in blocking solution) at 4° C. overnight. A secondary antibody cocktail consisting of a mixture of donkey anti-rabbit antibody conjugated to AlexaFluor 555 (Life Technologies, 1:200 dilution (2 mg/mL)), AlexaFluor 555-phalloidin and AlexaFluor 647-phalloidin (Molecular Probes, 1:200 dilution (2 mg/mL)) as a counterstain to label filamentous actin was applied for 2 h. Samples were mounted on glass coverslips with Vectashield mounting medium (Vector Laboratories), and imaged at 10×-63× magnification using a Zeiss LSM800 confocal microscope. Three-dimensional projection images were generated from Z-stacks using ZenBlue (Zeiss).

Scanning Electron Microscopy (SEM)

SEM was performed at ~P30 (4 weeks) along the organ of Corti of control and mutant mice. Organ of Corti explants were fixed in 2.5% glutaraldehyde in 0.1 M cacodylate buffer (Electron Microscopy Sciences) supplemented with 2 mM CaCl2 for 1 hour at room temperature. Specimens were dehydrated in a graded series of acetone (35%, 70%, 95%, and 100% (×2)), critical-point dried from liquid CO2, sputter-coated with 4-5 nm of platinum (Q150T, Quorum Technologies, United Kingdom), and observed with a field emission scanning electron microscope (S-4800, Hitachi, Japan).

Auditory Brainstem Responses (ABR)

ABR recordings were conducted from mice anesthetized via IP injection (0.1 mL/10 g-body weight) with 1 mL of ketamine (50 mg/mL) and 0.75 mL of xylazine (20 mg/mL). Subcutaneous needle electrodes were inserted into the skin (a) dorsally between the two ears (reference electrode); (b) behind the left pinna (recording electrode); and (c) dorsally at the rump of the animal (ground electrode). Prior to the onset of ABR testing, the meatus at the base of the pinna was trimmed away to expose the ear canal, and sound pressure at the entrance of the ear canal was calibrated for each individual test subject at all stimulus frequencies. For ABR recordings the ear canal and hearing apparatus (EPL Acoustic system, MEE, Boston) were presented with 5-millisecond tone pips. ABR potentials were amplified (10,000×), filtered (0.3-10 kHz), and digitized using custom data acquisition software (LabVIEW) from the Eaton-Peabody Laboratories Cochlear Function Test Suite. Sound level was raised in 5 to 10 dB steps from 0 to 110 dB sound pressure level (decibels SPL). At each level, 512 to 1024 responses were averaged (with stimulus polarity alternated) after "artifact rejection". Threshold was determined by visual inspection. Data were analyzed and plotted using Origin-2015 (OriginLab Corporation, MA).

Distortion Product Otoacoustic Emissions (DPOAE)

DPOAE data were collected under the same conditions, and during the same recording sessions, as ABR data. DPOAE at 2f1−f2 were measured with f2 frequencies from 5.6 to 45.2 kHz in half-octave steps (f2/f1=1.22) and L1−L2=10 dB SPL. At each f2, L2 was varied between 10 and 80 dB sound-pressure level (SPL) in 10 dB SPL increments. DPOAE threshold was defined from the average spectra as the L2-level eliciting a DPOAE of magnitude 5 dB SPL above the noise floor. The mean noise floor level was under 0 dB across all frequencies. Iso-response curves were interpolated from plots of DPOAE amplitude versus sound level. Threshold was defined as the f2 level required to produce DPOAEs above 0 dB.

In Vivo Injection of AAV

Inner ear injections were performed as approved by the Institutional Animal Care and Use Committees at Boston Children's Hospital animal protocol #17-03-3396R and 18-01-3610R. Pups were anesthetized by rapid induction of hypothermia for 2-4 minutes on ice water until loss of consciousness, and this state was maintained on a cooling platform for 10-15 minutes during the surgery. Approximately 1 μL of dual AAV were injected in neonatal mice P0-P1. Upon anesthesia, post-auricular incision was made to expose the otic bulla and visualize the cochlea. Standard post-operative care was applied.

Statistical Analysis

Statistical analyses were performed with Origin 2016 (OriginLab Corporation) or Prism 7. Data are presented as mean values ±standard deviations (SD) or standard error of the mean (SEM) as noted in the text and figure legend. Student's t-test was used to determine statistical significance (p-values). Error bars and n values of biological replicates for experiments are defined in the respective paragraphs and figure legends.

TABLE 3

Primers used for high-throughput DNA sequencing.

| Primer Name | Sequence |
|---|---|
| HTS_fwd_Baringo_gDNA | TGGAGTTCAGACGTGTGCTCTTCCGATCTCCCTTATTGGAA GTCAGGGCTTA (SEQ ID NO: 579) |
| HTS_rev_Baringo_gDNA | ACACTCTTTCCCTACACGACGCTCTTCCGATCTNNNNGGA GGATCACTAAGAGAAGGCT (SEQ ID NO: 580) |

TABLE 3-continued

| Primers used for high-throughput DNA sequencing. | |
|---|---|
| Primer Name | Sequence |
| HTS_fwd_Baringo_cDNA | ACACTCTTTCCCTACACGACGCTCTTCCGATCTNNNNAATG AAGGCGCTCTTGGGAA (SEQ ID NO: 581) |
| HTS_rev_Baringo_cDNA | TGGAGTTCAGACGTGTGCTCTTCCGATCTCGTACGGTAAA CCCCAGAGG (SEQ ID NO: 582) |
| HTS_fwd_Baringo_off_1 | ACACTCTTTCCCTACACGACGCTCTTCCGATCTNNNNGGTG TCCGCCTGGCTC (SEQ ID NO: 583) |
| HTS_rev_Baringo_off_1 | TGGAGTTCAGACGTGTGCTCTTCCGATCTCACCTGTCCTCT GGTCTGGA (SEQ ID NO: 584) |
| HTS_fwd_Baringo_off_2 | ACACTCTTTCCCTACACGACGCTCTTCCGATCTNNNNACAA AAGAAGGGGGAGCGAC (SEQ ID NO: 585) |
| HTS_rev_Baringo_off_2 | TGGAGTTCAGACGTGTGCTCTTCCGATCTTGCACAGCATA AAAGGGTGC (SEQ ID NO: 586) |
| HTS_fwd_Baringo_off_3 | ACACTCTTTCCCTACACGACGCTCTTCCGATCTNNNNGGCA AGGGGCATCCTTATGT (SEQ ID NO: 587) |
| HTS_rev_Baringo_off_3 | TGGAGTTCAGACGTGTGCTCTTCCGATCTCACTGAAACTTG CCATCGCC (SEQ ID NO: 496) |
| HTS_fwd_Baringo_off_4 | ACACTCTTTCCCTACACGACGCTCTTCCGATCTNNNNTCTG AACAGGTTAGAGGGTGC (SEQ ID NO: 497) |
| HTS_rev_Baringo_off_4 | TGGAGTTCAGACGTGTGCTCTTCCGATCTAATTCCTAAGTT CCAGGGAGTC (SEQ ID NO: 498) |
| HTS_fwd_Baringo_off_5 | ACACTCTTTCCCTACACGACGCTCTTCCGATCTNNNNGCTC ATTCTAAAATTCATAGCCT (SEQ ID NO: 499) |
| HTS_rev_Baringo_off_5 | TGGAGTTCAGACGTGTGCTCTTCCGATCTTAGCATGCTGGG AACCAGAC (SEQ ID NO: 500) |
| HTS_fwd_Baringo_off_6 | ACACTCTTTCCCTACACGACGCTCTTCCGATCTNNNNAGGT CCTAGGGTCATTCGGG (SEQ ID NO: 501) |
| HTS_rev_Baringo_off_6 | TGGAGTTCAGACGTGTGCTCTTCCGATCTAGTAGCCTTCAG CTGCCAAC (SEQ ID NO: 502) |
| HTS_fwd_Baringo_off_7 | ACACTCTTTCCCTACACGACGCTCTTCCGATCTNNNNGCCT CTGACTGTGTGGCAAG (SEQ ID NO: 503) |
| HTS_rev_Baringo_off_7 | TGGAGTTCAGACGTGTGCTCTTCCGATCTACATTGCCTTCT CCACTCTTCC (SEQ ID NO: 504) |
| HTS_fwd_Baringo_off_8 | ACACTCTTTCCCTACACGACGCTCTTCCGATCTNNNNACCA GGGCATGTCATGAAAAC (SEQ ID NO: 505) |
| HTS_rev_Baringo_off_8 | TGGAGTTCAGACGTGTGCTCTTCCGATCTCAGGAGCACAC CTATCAGGC (SEQ ID NO: 506) |
| HTS_fwd_Baringo_off_9 | ACACTCTTTCCCTACACGACGCTCTTCCGATCTNNNNACTA GAGCCACTAGGAAGAGGG (SEQ ID NO: 507) |
| HTS_rev_Baringo_off_9 | TGGAGTTCAGACGTGTGCTCTTCCGATCTTTCTAGCTTGCT CCTGGGCT (SEQ ID NO: 508) |

TABLE 4

| CRISPResso2 output for base editing at the target locus. | |
|---|---|
| Sequence | % conversion |
| CCACCTGAGGAA**T**AGGAAG*TA*CGAGGCCACTGAGGAAC (SEQ ID NO: 509) | 25.23 |
| CCACCTGAGGAA**T**AGGAAG*TA***T**GAGGCCACTGAGGAAC (SEQ ID NO: 510) | 10.51 |
| CCACCTGAGGAACAGGAAG*TA*CGAGGCCACTGAGGAAC (SEQ ID NO: 511) | 6.73 |
| CCACCTGAGGAACAGGAAG*TA***T**GAGGCCACTGAGGAAC (SEQ ID NO: 512) | 1.37 |

An example of the CRISPResso2 output from a single AID-BE4max-mediated base editing experiment is shown. The c.A545G mutation is in italics, silent bystander cytosines are bold, and the AGG PAM is underlined. The total conversion to sequences encoding wild-type TMC1 protein was 44%.

TABLE 5

List of base editing targets to correct known pathogenic point mutations in TMC1.

| Base editor | Pathogenic Mutation | GRCh37-Chromo | GRCh37-Location |
|---|---|---|---|
| ABE | NM_138691.2(TMC1):c.−540C>T | 9 | 75136717 |
| ABE | NM_138691.2(TMC1):c.−350C>T | 9 | 75192895 |
| n/a | NM_138691.2(TMC1):c.−329C>A | 9 | 75192916 |
| ABE | NM_138691.2(TMC1):c.−252C>T | 9 | 75231337 |
| ABE | NM_138691.2(TMC1):c.−220C>T | 9 | 75231369 |
| CBE | NM_138691.2(TMC1):c.−124T>C | 9 | 75242908 |
| n/a | NM_138691.2(TMC1):c.7C>A (p.Pro3Thr) | 9 | 75263571 |
| ABE | NM_138691.2(TMC1): c.65−10C>T | 9 | 75309449 |
| ABE | NM_138691.2(TMC1):c.100C>T (p.Arg34Ter) | 9 | 75309494 |
| n/a | NM_138691.2(TMC1):c.135C>A (p.Thr45=) | 9 | 75309529 |
| n/a | NM_138691.2(TMC1):c.141T>A (p.Asp47Glu) | 9 | 75309535 |
| n/a | NM_138691.2(TMC1):c.145A>C (p.Ile49Leu) | 9 | 75309539 |
| ABE | NM_138691.2(TMC1): c.236+1G>A | 9 | 75309631 |
| n/a | NM_138691.2(TMC1): c.237−5T>A | 9 | 75315429 |
| n/a | NM_138691.2(TMC1):c.241G>A (p.Glu81Lys) | 9 | 75315438 |

TABLE 5-continued

List of base editing targets to correct known pathogenic point mutations in TMC1.

| Base editor | Pathogenic Mutation | GRCh37-Chromo | GRCh37-Location |
|---|---|---|---|
| CBE | NM_138691.2(TMC1):c.265T>C (p.Leu89=) | 9 | 75315462 |
| ABE | NM_138691.2(TMC1):c.339G>A (p.Met113Ile) | 9 | 75315536 |
| n/a | NM_138691.2(TMC1):c.373A>C (p.Lys125Gln) | 9 | 75355045 |
| ABE | NM_138691.2(TMC1):c.403G>A (p.Gly135Arg) | 9 | 75355075 |
| ABE | NM_138691.2(TMC1):c.421C>T (p.Arg141Trp) | 9 | 75355093 |
| ABE | NM_138691.2(TMC1):c.448G>A (p.Ala150Thr) | 9 | 75355120 |
| ABE | NM_138691.2(TMC1):c.472C>T (p.Arg158Cys) | 9 | 75357378 |
| ABE | NM_138691.2(TMC1):c.473G>A (p.Arg158His) | 9 | 75357379 |
| ABE | NM_138691.2(TMC1):c.483G>A (p.Glu161=) | 9 | 75357389 |
| n/a | NM_138691.2(TMC1):c.534A>T (p.Glu178Asp) | 9 | 75357440 |
| n/a | NM_138691.2(TMC1):c.557C>G (p.Ala186Gly) | 9 | 75366787 |
| n/a | NM_138691.2(TMC1):c.603T>G (p.Val201=) | 9 | 75366833 |
| n/a | NM_138691.2(TMC1):c.624C>A (p.Ser208Arg) | 9 | 75366854 |
| ABE | NM_138691.2(TMC1):c.637C>T (p.Pro213Ser) | 9 | 75366867 |
| ABE | NM_138691.2(TMC1):c.674C>T | 9 | 75369733 |
| ABE | NM_138691.2(TMC1):c.684C>T (p.Thr228=) | 9 | 75369743 |
| n/a | NM_138691.2(TMC1):c.703G>T (p.Ala235Ser) | 9 | 75369762 |
| ABE | NM_138691.2(TMC1): c.742−12G>A | 9 | 75387317 |
| ABE | NM_138691.2(TMC1):c.760G>A (p.Val254Ile) | 9 | 75387347 |
| n/a | NM_138691.2(TMC1):c.777T>C (p.Tyr259=) | 9 | 75387364 |

The ClinVar database was searched for pathogenic SNPs in TMC1. Of all 108 pathogenic mutations found in patients, 72 mutations are in principle reversible with CBE or ABE nucleobase editor.

Exemplary guide sequences (expressed as protospacer sequences) suitable for targeting the NPC1 genes and used in the experiments of Examples 1-4 are provided in Table 6 below. The base editor and target correction is shown alongside the relevant guide sequence. Associated amino acid changes in the Niemann-Pick C1 (NPC1) protein are also shown. The target nucleotide (C or A) in the guide sequence is capitalized.

TABLE 6

List of guide RNA sequences used to correct known pathogenic point mutations in NPC1.

| Base editor | Pathogenic Mutation | Guide sequence | SEQ ID NO: |
|---|---|---|---|
| CBE | NM_000271.5(NPC1):c.3591 + 2T > C | ctccgCgagtaccctgagca | 669 |
| ABE | NM_000271.5(NPC1):c.3591 + 1G > A | ctccAtgagtaccctgagca | 670 |
| CBE | NM_000271.5(NPC1):c.3566A > G (p.Glu1189Gly) | gccCcttccgcgcgctccac | 671 |
| ABE | NM_000271.5(NPC1):c.3503G > A (p.Cys1168Tyr) | ttctAcagccacataaccag | 672 |
| ABE | NM_000271.5(NPC1):c.3477 + 2T > C | gtgatggAgagtcctcatac | 673 |

TABLE 6-continued

List of guide RNA sequences used to correct known pathogenic point mutations in NPC1.

| Base editor | Pathogenic Mutation | Guide sequence | SEQ ID NO: |
|---|---|---|---|
| CBE | NM_000271.5(NPC1):c.3467A > G (p.Asn1156Ser) | caggtCgaccaaggatacag | 674 |
| ABE | NM_000271.5(NPC1):c.3451G > A (p.Ala1151Thr) | cActgtatccttggtcaacc | 675 |
| CBE | NM_000271.5(NPC1):c.3425T > C (p.Met1142Thr) | ttaCgtggctctggggcatc | 676 |
| ABE | NM_000271.5(NPC1):c.3289G > A (p.Asp1097Asn) | gacAacactatcttcaacct | 677 |
| CBE | NM_000271.5(NPC1):c.3259T > C (p.Phe1087Leu) | tgtcCtctacgaacagtacc | 678 |
| CBE | NM_000271.5(NPC1):c.3246 - 2A > G | cacacCggaggggagaggg | 679 |
| ABE | NM_000271.5(NPC1):c.3229C > T (p.Arg1077Ter) | tcgAtaggcactgccgttaa | 680 |
| CBE | NM_000271.5(NPC1):c.3182T > C (p.Ile1061Thr) | cttaCagccagtaatgtcac | 681 |
| ABE | NM_000271.5(NPC1):c.3175C > T (p.Arg1059Ter) | aagtcAggctttcttcagag | 682 |
| ABE | NM_000271.5(NPC1):c.3160G > A (p.Ala1054Thr) | ttgacActctgaagaaagcc | 683 |
| CBE | NM_000271.5(NPC1):c.3127A > G (p.Thr1043Ala) | gCgtggtaggtcatgaagta | 684 |
| ABE | NM_000271.5(NPC1):c.3104C > T (p.Ala1035Val) | gtacgtgActccgaccctgg | 685 |
| CBE | NM_000271.5(NPC1):c.3056A > G (p.Tyr1019Cys) | actaCaggcagcatgtcccc | 686 |
| ABE | NM_000271.5(NPC1):c.3042 - 1G > A | tcaAgggacatgctgcctat | 687 |
| ABE | NM_000271.5(NPC1):c.2974G > A (p.Gly992Arg) | ctcagAggggagacttcatg | 688 |
| ABE | NM_000271.5(NPC1):c.2932C > T (p.Arg978Cys) | cagcAaacgcaggcagggt | 689 |
| ABE | NM_000271.5(NPC1):c.2893C > T (p.Gln965Ter) | aactAgtcagtgatattgtc | 690 |
| ABE | NM_000271.5(NPC1):c.2873G > A (p.Arg958Gln) | tgtcAagtggacaatatcac | 691 |
| ABE | NM_000271.5(NPC1):c.2872C > T (p.Arg958Ter) | actcAacagcaagacgactg | 692 |
| ABE | NM_000271.5(NPC1):c.2861C > T (p.Ser954Leu) | gcaagacAactgtggcttca | 693 |
| ABE | NM_000271.5(NPC1):c.2848G > A (p.Val950Met) | ggAtgaagccacagtcgtct | 694 |
| ABE | NM_000271.5(NPC1):c.2842G > A (p.Asp948Asn) | tttcAactgggtgaagccac | 695 |
| ABE | NM_000271.5(NPC1):c.2830G > A (p.Asp944Asn) | gatcAacgattatttcgact | 696 |
| ABE | NM_000271.5(NPC1):c.2819C > T (p.Ser940Leu) | acAagggggcgaagcctatt | 697 |
| ABE | NM_000271.5(NPC1):c.2801G > A (p.Arg934Gln) | ccAaataggcttcgccccct | 698 |
| ABE | NM_000271.5(NPC1):c.2780C > T (p.Ala927Val) | gcAccgcgttaaatatctgc | 699 |
| ABE | NM_000271.5(NPC1):c.2764C > T (p.Gln922Ter) | ctActgcaccagggaatcat | 700 |
| ABE | NM_000271.5(NPC1):c.2761C > T (p.Gln921Ter) | ctAcaccagggaatcattgt | 701 |
| ABE | NM_000271.5(NPC1):c.2728G > A (p.Gly910Ser) | tgtgcAgcggcatgggctgc | 702 |
| ABE | NM_000271.5(NPC1):c.2713C > T (p.Gln905Ter) | gttctAcccccttggaagaag | 703 |
| ABE | NM_000271.5(NPC1):c.2665G > A (p.Val889Met) | gcctAtgtactttgtcctgg | 704 |
| ABE | NM_000271.5(NPC1):c.2660C > T (p.Pro887Leu) | gcAgacccgcatgcaggtac | 705 |
| ABE | NM_000271.5(NPC1):c.2594C > T (p.Ser865Leu) | gcatcAaaagagactgatcc | 706 |
| CBE | NM_000271.5(NPC1):c.2474A > G (p.Tyr825Cys) | agaaCaggagtttttgaaga | 707 |
| ABE | NM_000271.5(NPC1):c.2366G > A (p.Arg789His) | ttaaacAtcaagaggtaagt | 708 |
| ABE | NM_000271.5(NPC1):c.2128C > T (p.Gln710Ter) | atacctAgtaggcctgcacc | 709 |
| ABE | NM_000271.5(NPC1):c.2072C > T (p.Pro691Leu) | cAggatgacttcaatcacaa | 710 |

TABLE 6-continued

List of guide RNA sequences used to correct known pathogenic point mutations in NPC1.

| Base editor | Pathogenic Mutation | Guide sequence | SEQ ID NO: |
|---|---|---|---|
| CBE | NM_000271.5(NPC1):c.2054T > C (p.Ile685Thr) | caCtgtgattgaagtcatcc | 711 |
| ABE | NM_000271.5(NPC1):c.2050C > T (p.Leu684Phe) | gaAggtcaagggcaaccca | 712 |
| ABE | NM_000271.5(NPC1):c.1990G > A (p.Val664Met) | tcAtgctgagctcggtggct | 713 |
| ABE | NM_000271.5(NPC1):c.1948 - 1G > A | tcaAgtggattcgaaggtct | 714 |
| ABE | NM_000271.5(NPC1):c.1947 + 1G > A | tctgAtaagccgggggggg | 715 |
| ABE | NM_000271.5(NPC1):c.1918G > A (p.Gly640Arg) | ccttgAggcacatgaaaagc | 716 |
| CBE | NM_000271.5(NPC1):c.1832A > G (p.Asp611Gly) | tcaCcttcaatacttcgttc | 717 |
| ABE | NM_000271.5(NPC1):c.1819C > T (p.Arg607Ter) | tcAttcagcagtgaaggaaa | 718 |
| ABE | NM_000271.5(NPC1):c.1628C > T (p.Pro543Leu) | cacAggaacactggtccacc | 719 |
| ABE | NM_000271.5(NPC1):c.1554 - 1009G > A | acAggtgggtcatatgcaga | 720 |
| ABE | NM_000271.5(NPC1):c.1553G > A (p.Arg518Gln) | tacAgtaagtggcaagagac | 721 |
| ABE | NM_000271.5(NPC1):c.1552C > T (p.Arg518Trp) | accAtacgcagtacagaaag | 722 |
| ABE | NM_000271.5(NPC1):c.1547G > A (p.Cys516Tyr) | actAcgtacggtaagtggca | 723 |
| ABE | NM_000271.5(NPC1):c.1421C > T (p.Pro474Leu) | atacAgtgaaagaggggcca | 724 |
| ABE | NM_000271.5(NPC1):c.1339C > T (p.Gln447Ter) | ttAtaagtcaagaacctgaa | 725 |
| ABE | NM_000271.5(NPC1):c.1327 - 1G > A | caAgttcttgacttacaaat | 726 |
| ABE | NM_000271.5(NPC1):c.81G > A (p.Trp27Ter) | tgAtatggagagtgtggaat | 727 |
| ABE | NM_000271.5(NPC1):c.1312C > T (p.Gln438Ter) | ctAtatgtcaagcggaggtc | 728 |
| ABE | NM_000271.5(NPC1):c.1298C > T (p.Pro433Leu) | ggaAgtccaaagggtacatc | 729 |
| ABE | NM_000271.5(NPC1):c.1219C > T (p.Gln407Ter) | agctActccgtccggaagaa | 730 |
| ABE | NM_000271.5(NPC1):c.1211G > A (p.Arg404Gln) | ttccAgacggagcagctcat | 731 |
| ABE | NM_000271.5(NPC1):c.3G > A (p.Met1Ile) | cagcatAaccgctcgcggcc | 732 |
| ABE | NM_000271.5(NPC1):c.1165C > T (p.Arg389Cys) | caggcAagcctggctgctgg | 733 |
| ABE | NM_000271.5(NPC1):c.1142G > A (p.Trp381Ter) | ctAgtcagcccccagcagcc | 734 |
| CBE | NM_000271.5(NPC1):c.1133T > C (p.Val378Ala) | aatccagCtgacctctggtc | 735 |
| ABE | NM_000271.5(NPC1):c.956 - 1G > A | ccaAgagaggcgtcctgctg | 736 |
| CBE | NM_000271.5(NPC1):c.1A > G (p.Met1Val) | ggtcaCgctgtggccgcgca | 737 |
| ABE | NM_000271.5(NPC1):c.721C > T (p.Gln241Ter) | tcttAgcagctacatggtgc | 738 |
| CBE | NM_000271.5(NPC1):c.631 + 2T > C | aggCaggtataaagattcca | 739 |
| ABE | NM_000271.5(NPC1):c.530G > A (p.Cys177Tyr) | ctgtAtgggaaggacgctga | 740 |
| ABE | NM_000271.5(NPC1):c.433C > T (p.Gln145Ter) | tattAtaactctttcacatt | 741 |
| ABE | NM_000271.5(NPC1):c.346C > T (p.Arg116Ter) | tctgtcAagggctacatgtc | 742 |
| CBE | NM_000271.5(NPC1):c.337T > C (p.Cys113Arg) | tgacaCgtagccctcgacag | 743 |

Example 5: Image Analyses

Figure 23:
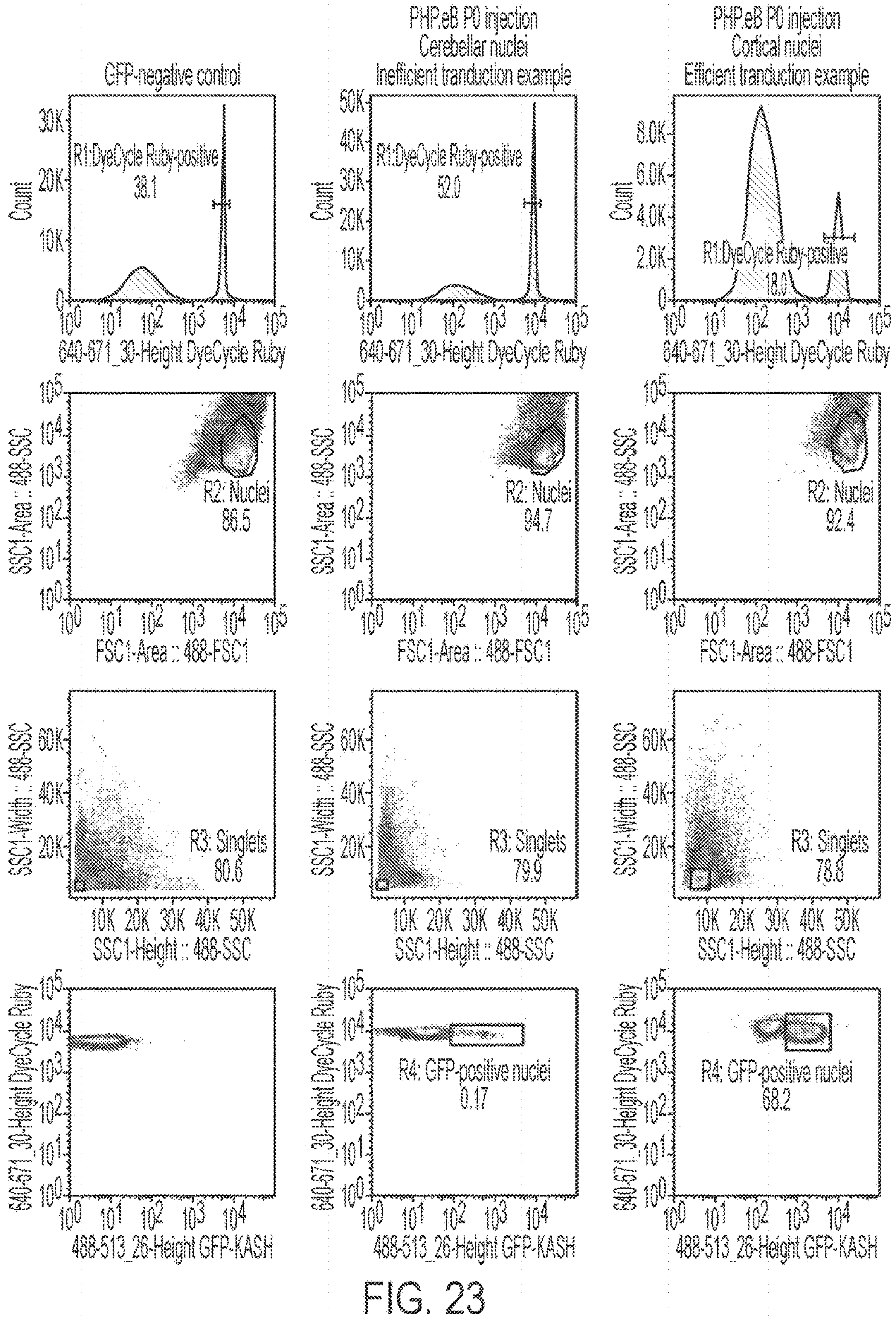
FIG. 23 contains flow cytometry plots exemplifying brain nuclei sorting. Plots show 500,000 events. Nuclei were sequentially gated on the basis of DyeCycle Ruby signal, FSC/SSC ratio, SSC-Width/SSC-height ratio, and GFP/DyeCycle ratio, as shown above. The first column demonstrates the gating strategy on a GFP-negative control sample. The middle column demonstrates the gating strategy on a sample with low transduction (P0 injection, cerebellar tissue), and the right column demonstrates high transduction efficiency (P0 injection, cortical tissue). In all cases, unsorted nuclei correspond to events that pass gates R1, R2, and R3, without sorting on R4.
Figure 24:
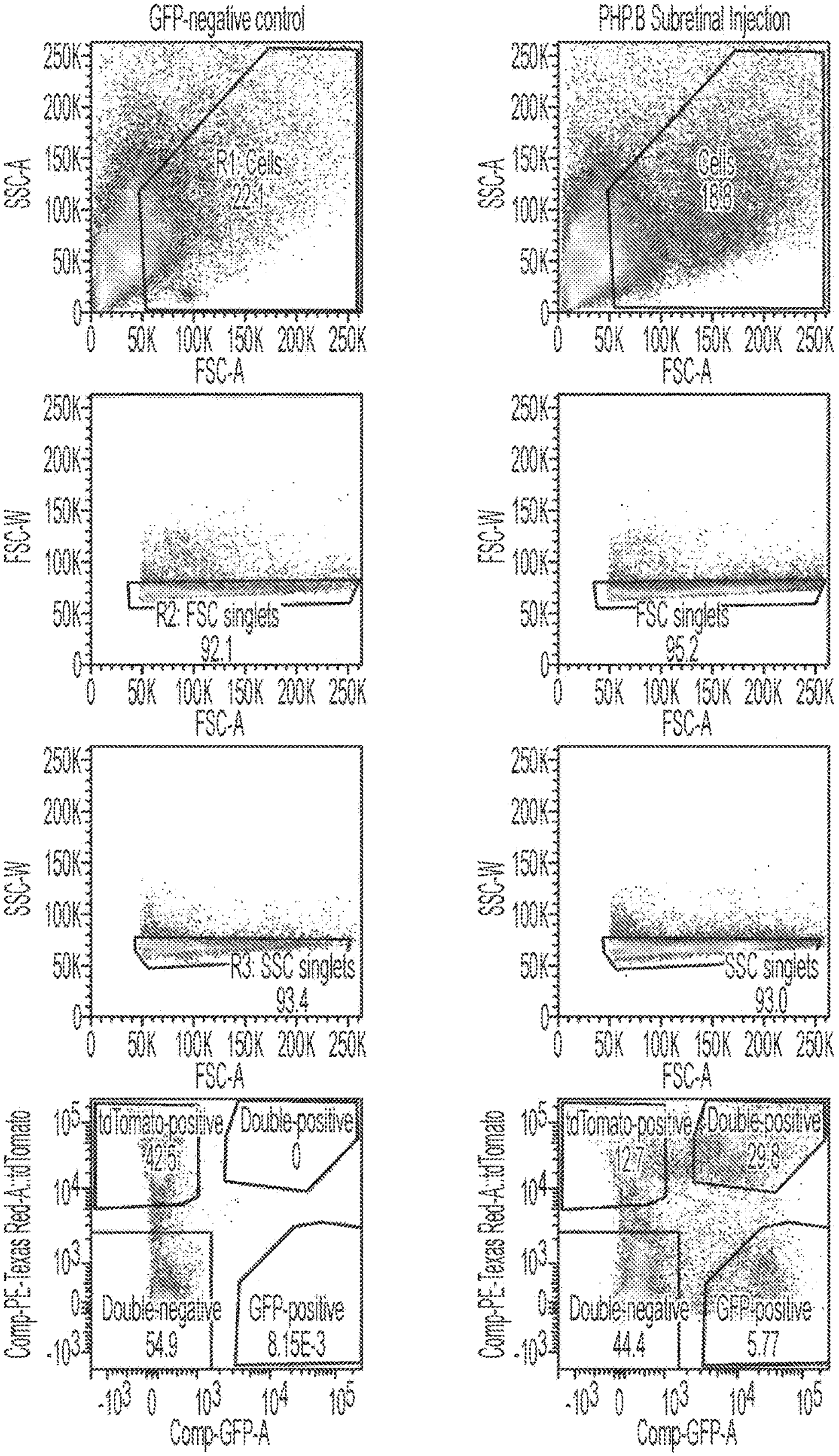
FIG. 24 contains flow cytometry plots exemplifying retinal cell sorting. Plots show 250,000 events. Cells were sequentially gated on the basis of FSC/SSC ratio, FSC-W/FSC-A, SSC-W/FSC-A, and fluorescence. Cells were sorted four ways on the basis of signal intensity in the PE-Texas Red and GFP channels. The left column illustrates the gating strategy on an untransduced Rho-Cre; Ai9 mouse with tdTomato-positive rod photoreceptors. The right column illustrates the gating strategy on an Rho-Cre; Ai9 mouse co-injected with PHP.B GFP and v5 CBE3.9max.
Figure 27:
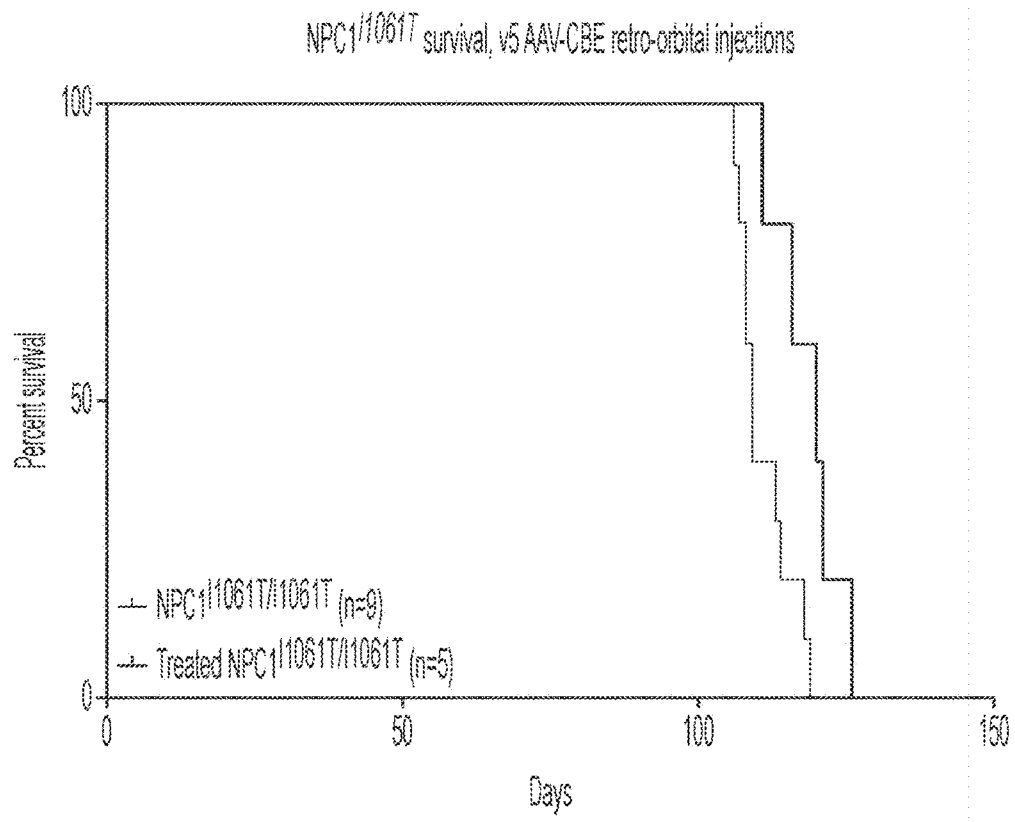
FIG. 27 shows a Kaplan-Meier plot of homozygous $NPC1^{I1061T}$ mice injected with $4\times10^{12}$ vg total of v5 CBE3.9max. Mice were injected with $3\times10^{12}$ vg PHP.eB and $1\times10^{12}$ vg AAV9 targeting $NPC1^{I1061T}$ (blue; n=5) or untreated homozygous $NPC1^{I1061T}$ mice (red; n=9). Tick marks indicate animal deaths. Median survival increases from 109 to 120 days, p=0.015 by Mantel-Cox.

To minimize variability, tissue from all conditions was harvested and processed at the same time. A single set of microscope settings was used to collect all images in FIGS. 23 and 24. The AxioScan czi to tif converter was used to convert czi files to multichannel tiffs.

For the determination of GFP nuclei (FIGS. 11A-11E), Purkinje neuron counts, and $CD68^+$ cell counts (FIGS. 15A-15H), ilastik was used to identify fluorescent objects.

Experimenter-annotated images (cropped subfields of the images included for publication) were used to manually train the pixel classification module of the program to accurately identify nuclei based on size and morphology. The trained pixel classification module was then used to analyze all images. The probability files from ilastik were imported into CellProfiler for counting. In CellProfiler, objects were detected and counted using the "Mask Image", "Smooth", "Enhance Edge," "Identify Primary Objects," and "calculate statistic" modules, and the program was instructed to only count objects with specific diameters (GFP images were set to 15 and 100 pixels; CD68 images were set between 10 and 100 pixels). The "Overlay Outlines" module, which generates an image of outlined objects, was used to manually check the automated output. ilastik and Cell Profiler are available at ilastik.org/documentation/pixelclassification/pixelclassification.html and Cellprofiler.org, respectively. The percentage of CD68+ area in the brain was calculated using CellProfiler and ImageJ by dividing the total CD68+ area from "Calculate Statistic" in CellProfiler with total brain area as manually outlined in ImageJ. For quantification of GFP image intensity in FIGS. 11A-11E, ImageJ was used to quantify overall image intensity. A custom macro programmed in the ImageJ macro language (IJM) and generated from Imager s batch processing macro template was used to identify brain tissue, subtract background with a rolling-ball algorithm, and quantify signal intensity. The output is a csv file of the 8-bit image intensity histogram. Each of the 256 rows was a paired (intensity, pixel #) value, with the sum of all pixel #'s adding to the number of pixels in the image. Pixels with an intensity of 1-15 (of 256) were manually set to an intensity of zero after visual inspection showed these pixels corresponded to small-diameter background fluorescence which was not removed by the rolling-ball algorithm (radius=100 px).

```
/*
* Macro template to process multiple images in a folder
*/
run("Bio-Formats Macro Extensions");
#@ File (label = "Input directory", style = "directory") input
#@ File (label = "Output directory", style = "directory") output
#@ String (label = "File suffix", value = ".tif") suffix
processFolder(input);
// function to scan folders/subfolders/files to find files with correct suffix
function processFolder(input) {
list = getFileList(input);
list = Array.sort(list);
for (i = 0; i < list.length; i++) {
if(File.isDirectory(input + File.separator + list[i]))
processFolder(input + File.separator + list[i]);
if(endsWith(list[i], suffix))
processFile(input, output, list[i]);
}
}
function processFile(input, output, file) {
// Do the processing here by adding your own code.
// Leave the print statements until things work, then remove them.
print("Processing: " + input + File.separator + file);
active_image = input+File.separator+file;
open(active_image);
Stack.setChannel(1); //DAPI
run("Enhance Contrast", "saturated=0.35");
setAutoThreshold("Triangle dark no-reset");
Stack.setChannel(2); //GFP
setMinAndMax(0, 10000);
DAPI="C1-" + getTitle;
GFP="C2-" + getTitle;
dir = getDirectory("image");
run("8-bit");
run("Split Channels");
selectWindow(DAPI);
```

-continued

```
run("Convert to Mask");
run("Create Selection");
roiManager("Add");
roiManager("Select", 0);
run("Enlarge...", "enlarge=60 pixel");
roiManager("Update");
roiManager("Select", 0);
run("Enlarge...", "enlarge=-60 pixel");
roiManager("Update");
selectWindow(GFP);
roiManager("Select", 0);
run("Subtract Background...", "rolling=100");
roiManager("Select", 0);
GFP_tiff_path = output+File.separator+GFP;
saveAs("Tiff", GFP_tiff_path);
histo_title=getInfo("window.title");
histo_save = output+File.separator+histo_title+".csv";
save_histogram( );
saveAs("Results", histo_save);
roiManager("Reset");
run("Close All");
}
function save_histogram( ) {
nBins = 256;
run("Clear Results");
row = 0;
getHistogram(values, counts, nBins);
for (i = 0; i<nBins; i++) {
setResult("Value", row, values[i]);
setResult("Count", row, counts[i]);
row++;
}
updateResults( );
}
```

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein.

It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

4. The nucleic acid molecule of claim 3 further comprising a woodchuck hepatitis posttranscriptional regulatory element (WPRE) inserted 5' of the transcriptional terminator.

5. The nucleic acid molecule of claim 3, wherein the transcriptional terminator is the transcriptional terminator from a bGH gene, hGH gene, or SV40 gene.

6. A composition comprising the nucleic acid molecule of claim 1 and a pharmaceutically acceptable carrier.

7. The nucleic acid molecule of claim 1, wherein the nucleic acid molecule comprises a sequence that is at least 95% a sequence selected from the group consisting of SEQ ID NOs: 642, 644, 646, 648, 650, and 652.

8. The nucleic acid molecule of claim 1, wherein the nucleic acid molecule comprises a sequence selected from the group consisting of SEQ ID NOs: 642, 644, 646, 648, 650, and 652.

9. The nucleic acid molecule of claim 1, wherein the first promoter is a Cbh promoter.

10. The nucleic acid molecule of claim 1, wherein the nucleobase editor comprises a cytosine deaminase.

11. The nucleic acid molecule of claim 1, wherein the nucleobase editor comprises an adenine deaminase.

12. The nucleic acid molecule of claim 1, wherein the nucleic acid molecule comprises a sequence that is at least 98% identical to a sequence selected from the group consisting of SEQ ID NOs: 642, 644, 646, 648, 650, and 652.

13. The nucleic acid molecule of claim 1, wherein the nucleic acid molecule comprises a sequence that is at least

SEQUENCE LISTING (743 sequences)

SEQ ID NO: 1 - protein, 1368 aa, S. pyogenes [sequence omitted]

SEQ ID NO: 2 - protein, 1360 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRI

SEQ ID NO: 3 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 5 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 6 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 7 - protein, 1053 aa, S. aureus
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 8 - protein, 1121 aa, Streptococcus thermophilus
MSDLVLGLAIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 9 - protein, 1388 aa, Streptococcus thermophilus
MTKPYSIGLAIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 10 - protein, 1053 aa, S. aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 11 - protein, 1054 aa, S. aureus
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFIKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 12 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 13 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 14 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 15 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 16 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 17 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 18 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 19 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 20 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 21 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 22 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 23 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 24 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 25 - protein, 1367 aa, Artificial Sequence
  Synthetic
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 26 - protein, 1210 aa, Unknown
  Uncultured Parcubacteria Group Bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 27 - protein, 1372 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 28 - protein, 1370 aa, Streptococcus mitis
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 29 - protein, 1056 aa, Staphylococcus aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 30 - protein, 1052 aa, S. pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 31 - protein, 1368 aa, S. pyogenes [sequence omitted]

SEQ ID NO: 32 - protein, 1368 aa, S. pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 34 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1368 aa, S. pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 36 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 37 - protein, 1367 aa, S. pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1367 aa, S. pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 40 - protein, 1367 aa, S. pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 41 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 42 - protein, 1368 aa, S. pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 43 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 44 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 45 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 46 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 47 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 48 - protein, 1368 aa, S. pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 49 - protein, 1193 aa, S. pyogenes
PDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 50 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - protein, 1367 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 52 - protein, 1368 aa, S. pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENLINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 53 - protein, 1279 aa, S. pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 543 aa, S. pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 55 - protein, 306 aa, S. pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 56 - protein, 1368 aa, Unknown
  MULTISPECIES: type II CRISPR RNA-guided endonuclease Cas9 [Streptococcus]
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 57 - protein, 1345 aa, Unknown
  MULTISPECIES: type II CRISPR RNA-guided endonuclease Cas9 [Streptococcus]
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 58 - protein, 1373 aa, Unknown
  MULTISPECIES: type II CRISPR RNA-guided endonuclease Cas9 [Streptococcus]
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 59 - protein, 1370 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 60 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 61 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 62 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 63 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 67 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 68 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 69 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 70 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 71 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 72 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 73 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 74 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 75 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 76 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 77 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 78 - protein, 1370 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1370 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 80 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 81 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 82 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 84 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 85 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 86 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 87 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 88 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 89 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 90 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 91 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 93 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 94 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 95 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 96 - protein, 1384 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 97 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 98 - protein, 1370 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 99 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 100 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 101 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 102 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 103 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 104 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 105 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 106 - protein, 1370 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 107 - protein, 1370 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASDLNGNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 108 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 109 - protein, 1346 aa, Streptococcus anginosus
MMKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 110 - protein, 1346 aa, Streptococcus anginosus
MMKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 111 - protein, 1345 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 112 - protein, 1377 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVRKLVAKSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 113 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 114 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 115 - protein, 1365 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTNLDNPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVRKFIAKSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 116 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 117 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 118 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 119 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 120 - protein, 1308 aa, Unknown
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVRQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 121 - protein, 1308 aa, Artificial Sequence
  Synthetic
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVRQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMANSNAATGEDYINSPVRDLNGVCFDSRFQNPEWPMDADANGAYHIALKGQLLLNHLKESKDLKLQNGISNQDWLAYIQELRN

SEQ ID NO: 122 - protein, 1259 aa, Unknown
  Lachnospiraceae bacterium GAM79
MNYKTGLEDFIGKESLSKTLRNALIPTESTKIHMEEMGVIRDDELRAEKQQELKEIMDDYYRTFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDVAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTILASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 123 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 124 - protein, 1142 aa, Eubacterium rectale
MFSAKLISDILPEFVIHNNNYSASEKEEKTQVIKLFSRFATSFKDYFKNRANCFSANDISSSSCHRIVNDNAEIFFSNALVYRRIVKNLSNDDINKISGDMKDSLKEMSLEEIYSYEKYGEFITQEGISFYNDICGKVNLFMNLYCQKNKENKNLYKLRKLHKQILCIADTSYEVPYKFESDEEVYQSVNGFLDNISSKHIVERLRKIGENYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSTYEDISGFYREVELQGYKIDWTYISEKDIDLLQEKGQLYLFQIYNKDFSKKSSGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 125 - protein, 1259 aa, Unknown
  Clostridium sp. AF34-10BH
MNYKTGLEDFIGKESLSKTLRNALIPTESTKIHMEEMGVIRDDELRAEKQQELKEIMDDYYRAFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYLVDFYDRVLTQPGIEYYNGICGKINEHMNQFCQKNRINKNDFRMKKLHKQILCKKSSYYEIPFRFESDQEVYDALNEFIKTMKEKEIICRCVHLGQKCDDYDLGKIYISSNKYEQISNALYGSWDTIRKCIKEEYMDALPGKGEKKEEKAEAAAKKEEYRSIADIDKIISLYGSEMDRTISAKKCITEICDMAGQISTDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPVVHKKGSVLVNRSYTQTVGDKEIRVSIPEEYYTEIYNYLNHIGRGKLSTEAQRYLEERKIKSFTATKDIVKNYRYCCDHYFLHLPITINFKAKSDIAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTMLASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 126 - protein, 1108 aa, Bacillus hisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 127 - protein, 1465 aa, Thermomonas hydrothermalis
MSEKTTQRAYTLRLNRASGECAVCQNNSCDCWHDALWATHKAVNRGAKAFGDWLLTLRGGLCHTLVEMEVPAKGNNPPQRPTDQERRDRRVLLALSWLSVEDEHGAPKEFIVATGRDSADDRAKKVEEKLREILEKRDFQEHEIDAWLQDCGPSLKAHIREDAVWVNRRALFDAAVERIKTLTWEEAWDFLEPFFGTQYFAGIGDGKDKDDAEGPARQGEKAKDLVQKAGQWLSARFGIGTGADFMSMAEAYEKIAKWASQAQNGDNGKATIEKLACALRPSEPPTLDTVLKCISGPGHKSATREYLKTLDKKSTVTQEDLNQLRKLADEDARNCRKKVGKKGKKPWADEVLKDVENSCELTYLQDNSPARHREFSVMLDHAARRVSMAHSWIKKAEQRRRQFESDAQKLKNLQERAPSAVEWLDRFCESRSMTTGANTGSGYRIRKRAIEGWSYVVQAWAEASCDTEDKRIAAARKVQADPEIEKFGDIQLFEALAADEAICVWRDQEGTQNPSILIDYVTGKTAEHNQKRFKVPAYRHPDELRHPVFCDFGNSRWSIQFAIHKEIRDRDKGAKQDTRQLQNRHGLKMRLWNGRSMTDVNLHWSSKRLTADLALDQNPNPNPTEVTRADRLGRAASSAFDHVKIKNVFNEKEWNGRLQAPRAELDRIAKLEEQGKTEQAEKLRKRLRWYVSFSPCLSPSGPFIVYAGQHNIQPKRSGQYAPHAQANKGRARLAQLILSRLPDLRILSVDLGHRFAAACAVWETLSSDAFRREIQGLNVLAGGSGEGDLFLHVEMTGDDGKRRTVVYRRIGPDQLLDNTPHPAPWARLDRQFLIKLQGEDEGVREASNEELWTVHKLEVEVGRTVPLIDRMVRSGFGKTEKQKERLKKLRELGWISAMPNEPSAETDEKEGEIRSISRSVDELMSSALGTLRLALKRHGNRARIAFAMTADYKPMPGGQKYYFHEAKEASKNDDETKRRDNQIEFLQDALSLWHDLFSSPDWEDNEAKKLWQNHIATLPNYQTPEEISAELKRVERNKKRKENRDKLRTAAKALAENDQLRQHLHDTWKERWESDDQQWKERLRSLKDWIFPRGKAEDNPSIRHVGGLSITRINTISGLYQILKAFKMRPEPDDLRKNIPQKGDDELENFNRRLLEARDRLREQRVKQLASRIIEAALGVGRIKIPKNGKLPKRPRTTVDTPCHAVVIESLKTYRPDDLRTRRENRQLMQWSSAKVRKYLKEGCELYGLHFLEVPANYTSRQCSRTGLPGIRCDDVPTGDFLKAPWWRRAINTAREKNGGDAKDRFLVDLYDHLNNLQSKGEALPATVRVPRQGGNLFIAGAQLDDTNKERRAIQADLNAAANIGLRALLDPDWRGRWWYVPCKDGTSEPALDRIEGSTAFNDVRSLPTGDNSSRRAPREIENLWRDPSGDSLESGTWSPTRAYWDTVQSRVIELLRRHAGLPTS

SEQ ID NO: 128 - protein, 1091 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVRQRMEE

SEQ ID NO: 129 - protein, 1194 aa, Dsulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 130 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 131 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 132 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 133 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 134 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 135 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 136 - protein, 24 aa, Artificial Sequence
  Synthetic
SGGSSGSETPGTSESATPESSGGS

SEQ ID NO: 137 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 138 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 139 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 140 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 141 - protein, 159 aa, Artificial Sequence
  Synthetic
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 142 - protein, 96 aa, Artificial Sequence
  Synthetic
SGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGS

SEQ ID NO: 143 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 144 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 145 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 146 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 147 - protein, 1348 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 148 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 149 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 150 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 151 - protein, 1372 aa, Streptococcus gallolyticus; identical to SEQ ID NO: 27

SEQ ID NO: 152 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 153 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 154 - protein, 1273 aa, Streptococcus iniae
  misc_feature (1267)..(1267): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFXEVKSSF

SEQ ID NO: 155 - protein, 1267 aa, Streptococcus iniae
  misc_feature (1265)..(1265): Xaa can be any naturally occurring amino acid
  misc_feature (1267)..(1267): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYXFX

SEQ ID NO: 156 - protein, 200 aa, Streptococcus iniae
MEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 157 - protein, 1281 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDVRLSQVFRVTNVEF

SEQ ID NO: 158 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 159 - protein, 1353 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGLYKKDAKRGLVPTSKRVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKISATERMRMYNNILKFISKDKKVDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVALLNFTMMGAATDFKFFGQIIPRKRYPSTTECLKSTLIHQSVTGLYETRIDLSKLGEN

SEQ ID NO: 160 - protein, 1376 aa, Streptococcus mitis
MNNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHGLDSNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLKRYISRTKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 161 - protein, 1370 aa, Streptococcus mitis; identical to SEQ ID NO: 28

SEQ ID NO: 162 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 163 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 166 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 168 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 169 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 170 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 171 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 172 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 173 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 174 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 175 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 176 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 177 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 178 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 179 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 180 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 181 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 182 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 183 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 184 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 185 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 186 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 187 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 188 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 189 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 190 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 191 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 192 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 193 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 194 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 195 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 196 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 197 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 198 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 199 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 200 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 201 - DNA, 125 bp, Artificial Sequence
  Synthetic
  misc_feature (1)..(8): n is a, c, g, or t
nnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 202 - DNA, 121 bp, Artificial Sequence
  Synthetic
  misc_feature (1)..(18): n is a, c, g, or t
nnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 203 - DNA, 109 bp, Artificial Sequence
  Synthetic
  misc_feature (1)..(20): n is a, c, g, or t
nnnnnnnnnnnnnnnnnnnngtttttgtactctcagaaatgcagaagctacaaagataaggcttcatgccgaaatcaacaccctgtcattttatggcagggtgtttttt

SEQ ID NO: 204 - DNA, 102 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtggcaccgagtcggtgctttttt

SEQ ID NO: 205 - DNA, 88 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtgttttttt

SEQ ID NO: 206 - DNA, 76 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcatttttttt

SEQ ID NO: 207 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 208 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 209 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 210 - protein, 1355 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 211 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 212 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 213 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 214 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 215 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 216 - protein, 1366 aa, Streptococcus parasanguinis
MKKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGSNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLKRYISRTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 217 - protein, 1337 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDKIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIEDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLASLVVKSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASAKELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 218 - protein, 1368 aa, Streptococcus phocae
MVEKKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDQLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKADGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLKRMVGKSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASATELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 219 - protein, 1376 aa, Streptococcus pseudopneumoniae
MSNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASGLNSNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLKRYISRSRDPKEIEKATEKYFFYSNLLNFFKEEVHYADGTIVKRENIEYSKDTGEIAWNKEIDFATIRKILSLSQVNIVKKTEEQTVGQNGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 220 - protein, 1376 aa, Streptococcus pseudopneumoniae
MSNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASGLNSKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIVKRENIEYSKDTGEIAWNKEKDFATIKKILSLPQVNIVKKTEEQTVGQNGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 221 - protein, 1378 aa, Streptococcus pseudopneumoniae
MSNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLKRYISRSKDPKDIEKATEKYFFYSNLLNFFKEEVHYADGTIVKRENIEYSKDTGEIAWNKEKDFATIKKVLSYPQVNIVKKTEEQTVGQNGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 222 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 223 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 224 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 225 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 226 - protein, 1371 aa, Unknown
  Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 227 - protein, 1361 aa, Unknown
  Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKSATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 228 - protein, 1375 aa, Unknown
  Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 229 - protein, 1371 aa, Unknown
  Streptococcus sp. taxon 056
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 230 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 231 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 232 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 233 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 234 - protein, 1386 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKNLDNPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 235 - protein, 1300 aa, Brochothrix thermosphacta
MWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSTLNRIIIPETIDINVFEKILLDRMMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKNIKKGLSAAYGKYSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELAASPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGPSERHNARQLIVSDEAAKVIWLISTKQADEAMFLKYYRLEHLEAVFEELIRKQAADYQIFEKLIKKIEVNKVYFYSCTYNEKVKVIEELLKITQANATNGDLKLLKMSNREGRLGSVSVALDFKIINQSVTGLYQSIEDYNN

SEQ ID NO: 236 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 237 - protein, 1389 aa, Unknown
  Cloning vector pYB196
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGPPKKKRKVYPYDVPDYA

SEQ ID NO: 238 - protein, 1335 aa, Unknown
  Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENLEIIYNDELLTQIENIFKQDISRSKKLDQAIALFQGVKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKKLLEKDEDEILEEIIKILTIFEDRKMRKRQLMKFKDKLSEKAINQLSKKHYTGWGQLSEKLINGIRDEQSNKTILDYLIEDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSVHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKIEGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGASKENDSKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 239 - protein, 1384 aa, Unknown
  CRISPR-mediated gene targeting vector p(bhsp68-Cas9)
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSGGAAG

SEQ ID NO: 240 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 241 - protein, 1337 aa, Unknown
  MULTISPECIES: Enterococcus
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 242 - protein, 1288 aa, Unknown
  MULTISPECIES: Enterococcus
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 243 - protein, 1079 aa, Unknown
  Enterococcus durans IPLA 655
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNTERVAELLEQPEMNAMFEDIVKILTIFEDREMIRTQLKKYQSVLGDGFFKKLVKKHYTGWGRLSERLINGIRDKKTNKTILDYLIDDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASHKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 244 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 245 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 246 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 247 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 248 - protein, 1339 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 249 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 250 - protein, 1337 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 251 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 252 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 253 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 254 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 255 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 256 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 257 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 258 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 259 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 260 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 261 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 262 - protein, 1336 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 263 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 264 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 265 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 266 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 267 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 268 - protein, 1330 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSDQMDTLLDDPDMTTMFEEIIKILTIFEDREMIREQLKPYETVLGLPAIKKLAKKHYTGWGRLSEKMIQGMREKQSRKTILDYLIDDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASHQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGERL

SEQ ID NO: 269 - protein, 1334 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEVPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSKVVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIEDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 270 - protein, 1330 aa, Unknown
  Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSKKTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLINDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 271 - protein, 1339 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYTEKIIELLEQPEMEEMFEDIVKIITIFEDREMVRTQLKKYQRILGEEIFKKLVKKKYTGWGRLSKRLINGIRDQKTNKTILDYLINDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASHQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 272 - protein, 1424 aa, Unknown
  Expression vector pCas9
MDYKDHDGDYKDHDIDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKK

SEQ ID NO: 273 - protein, 1343 aa, Kandleria vitulina
MSQNNNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNNKNKDKEFNKNKDGFILNSMRNLYADKDTGEVVWDPEWISRIKKCFYYKDCFVTKKLEENNGSFFNLTVRPNDEHSEKGTTIAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSPTEIVNARQLILDFNCTRIIDGIYKAMKYKNYSELSQEEIMNVYDIFVEKLKLYYPTYKNIATNFENMREQFENISDEEKCEVIRQMLVVMHAGPQNGNITFDDFKLSNRLGRLNCKTISLDTTVFIADSPTGMYSKKYKL

SEQ ID NO: 274 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 275 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDTYSFKETIKNAQVIEKEETLAKTVQELPGSPAIKKGILQSLEIVDEIIKVMGYKPKSIVVEMARETQKTHGTRKREDRVQQIVKNLKDANELPKKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 276 - protein, 198 aa, Homo sapiens [sequence omitted]

SEQ ID NO: 277 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 278 - protein, 198 aa, S. canis
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 279 - protein, 199 aa, Bos Bovis
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 280 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 281 - protein, 429 aa, Unknown
  Rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 282 - protein, 1387 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYG

SEQ ID NO: 283 - protein, 1388 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQ

SEQ ID NO: 284 - protein, 1387 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYS

SEQ ID NO: 285 - protein, 1388 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGS

SEQ ID NO: 286 - protein, 1387 aa, Artificial Sequence
  Synthetic
KPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRD

SEQ ID NO: 287 - protein, 357 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 288 - protein, 341 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 289 - protein, 328 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 290 - protein, 120 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 291 - protein, 69 aa, Artificial Sequence
  Synthetic
KPIREQAENIIHLFTLTNLGAPAAFKYFDTTIDRKRYTSTKEVLDATLIHQSITGLYETRIDLSQLGGD

SEQ ID NO: 292 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 293 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 294 - protein, 229 aa, Unknown [sequence omitted]

SEQ ID NO: 295 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 296 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 297 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 298 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 299 - protein, 84 aa, Unknown
  Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 300 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 301 - protein, 209 aa, Unknown
  UdgX
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 302 - protein, 313 aa, Unknown
  UDG
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 303 - protein, 1633 aa, Artificial Sequence
  Synthetic
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 304 - protein, 1623 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 305 - protein, 1630 aa, Artificial Sequence
  Synthetic
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 306 - protein, 1710 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 307 - protein, 1710 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 308 - protein, 1679 aa, Artificial Sequence
  Synthetic
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 309 - protein, 1689 aa, Artificial Sequence
  Synthetic
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 310 - protein, 1655 aa, Artificial Sequence
  Synthetic
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 311 - protein, 1665 aa, Artificial Sequence
  Synthetic
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 312 - protein, 1665 aa, Artificial Sequence
  Synthetic
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 313 - protein, 1612 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 314 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 315 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 316 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 317 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 318 - protein, 166 aa, Artificial Sequence
  Synthetic
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 319 - protein, 166 aa, Artificial Sequence
  Synthetic
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 320 - protein, 166 aa, Artificial Sequence
  Synthetic
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 321 - protein, 166 aa, Artificial Sequence
  Synthetic
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 322 - skipped

SEQ ID NO: 323 - protein, 1561 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 324 - protein, 1561 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 325 - protein, 1561 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 326 - protein, 1561 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 327 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 328 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 329 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 330 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 331 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 332 - protein, 1648 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 333 - protein, 1784 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 334 - protein, 1784 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 335 - protein, 1784 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 336 - protein, 1787 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 337 - protein, 1787 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 338 - protein, 1787 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 339 - protein, 1550 aa, Artificial Sequence
  Synthetic
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 340 - protein, 1550 aa, Artificial Sequence
  Synthetic
  misc_feature (155)..(155): Xaa can be any naturally occurring amino acid
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQXIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 341 - protein, 1782 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQAGGSPKKKRKV

SEQ ID NO: 342 - protein, 1785 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPGGSPKKKRKV

SEQ ID NO: 343 - protein, 24 aa, Artificial Sequence
  Synthetic
SGGSSGGSSGSETPGTSESATPES

SEQ ID NO: 344 - protein, 16 aa, Artificial Sequence
  Synthetic
KRPAATKKAGQAKKKK

SEQ ID NO: 345 - protein, 17 aa, Artificial Sequence
  Synthetic
KKTELQTTNAENKTKKL

SEQ ID NO: 346 - protein, 19 aa, Artificial Sequence
  Synthetic
KRGINDRNFWRGENGRKTR

SEQ ID NO: 347 - protein, 16 aa, Artificial Sequence
  Synthetic
RKSGKIAAIVVKRPRK

SEQ ID NO: 348 - DNA, 20 bp, Artificial Sequence
  Synthetic
gaagcgcctggcagtgtacc

SEQ ID NO: 349 - DNA, 21 bp, Artificial Sequence
  Synthetic
gacgtgcgcggccgcctggtg

SEQ ID NO: 350 - DNA, 305 bp, Artificial Sequence
  Synthetic
tgcctgtcatacgaaaccgagatactgacagtagaatatggccttctgccaatcgggaagattgtggagaaacggatagaatgcacagtttactctgtcgataacaatggtaaatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 351 - protein, 102 aa, Artificial Sequence
  Synthetic
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 352 - DNA, 108 bp, Artificial Sequence
  Synthetic
atgatcaagatagctacaaggaagtatcttggcaaacaaaacgtttatgatattggagtcgaaagagatcacaactttgctctgaagaacggattcatagcttctaat

SEQ ID NO: 353 - protein, 36 aa, Artificial Sequence
  Synthetic
MIKIATRKYLGKQNVYDIGVERDHNFALKNGFIASN

SEQ ID NO: 354 - DNA, 303 bp, Artificial Sequence
  Synthetic
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 355 - protein, 101 aa, Artificial Sequence
  Synthetic
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 356 - DNA, 159 bp, Artificial Sequence
  Synthetic
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 357 - protein, 53 aa, Artificial Sequence
  Synthetic
MKRTADGSEFESPKKKRKVKIISRKSLGTQNVYDIGVEKDHNFLLKNGLVASN

SEQ ID NO: 358 - protein, 159 aa, Artificial Sequence
  Synthetic
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 359 - RNA, 93 nt, S. pyogenes
guuuaagagcuaugcuggaaagccacggugaaaaaguucaacuauugccugaucggaauaaauuugaacgauacgacagucggugcuuuuuuu

SEQ ID NO: 360 - RNA, 82 nt, S. pyogenes
guuuaagagcuagaaauagcaaguuuaaauaaggcuaguccguuaucaacuugaaaaaguggcaccgagucggugcuuuuuu

SEQ ID NO: 361 - RNA, 97 nt, S. thermophilus
guuuuuguacucucaagauucaauaaucuugcagaagcuacaaagauaaggcuucaugccgaaaucaacacccugucauuuuauggcaggguguuuu

SEQ ID NO: 362 - protein, 1786 aa, Artificial Sequence
  Synthetic
MKRTADGSEFESPKKKRKVFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYHEDERNRQGLRDLVNSGVTIRIMDLPDYNYCWKTFVSDQGGDEDYWPGHFAPWIKQYSLKLSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 363 - RNA, 74 nt, C. jejuni
aagaaauuuaaaaagggacuaaaauaaagaguuugcgggacucugcgggguuacaauccccuaaaaccgcuuuu

SEQ ID NO: 364 - protein, 1853 aa, Artificial Sequence
  Synthetic
MKRTADGSEFESPKKKRKVSSETGPVAVDPTLRRRIEPHEFEVFFDPRELAAETCLLYEINWGGRHSIWRHTSQNTNKHVEVNFIEKFTTERYFCPNTRCSITWFLSWSPCGECSRAITEFLSRYPHVTLFIYIARLYHLANPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 365 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 366 - RNA, 110 nt, M. mobile
uguauuucgaaauacagauguacaguuaagaauacauaagaaugauacaucacuaaaaaaaggcuuuaugccguaacuacuacuuauuuucaaaauaaguaguuuuuuuu

SEQ ID NO: 367 - protein, 1395 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 368 - RNA, 89 nt, S. pyogenes
guuggaaccauucaaaacagcauagcaaguuaaaauaaggcuaguccguuaucaacuugaaaaaguggcaccgagucggugcuuuuuuu

SEQ ID NO: 369 - protein, 1539 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 370 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLTIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 371 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 372 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 373 - protein, 7 aa, Artificial Sequence
  Synthetic
PKKKRKV

SEQ ID NO: 374 - protein, 30 aa, Artificial Sequence
  Synthetic
MDSLLMNRRKFLYQFKNVRWAKGRRETYLC

SEQ ID NO: 375 - protein, 18 aa, Artificial Sequence
  Synthetic
KRTADGSEFESPKKKRKV

SEQ ID NO: 376 - DNA, 609 bp, Artificial Sequence
  Synthetic
gcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccg

SEQ ID NO: 377 - protein, 16 aa, Artificial Sequence
  Synthetic
SGSETPGTSESATPES

SEQ ID NO: 378 - protein, 4 aa, Artificial Sequence
  Synthetic
SGGS

SEQ ID NO: 379 - protein, 1605 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

SEQ ID NO: 380 - protein, 1803 aa, Artificial Sequence
  Synthetic
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

SEQ ID NO: 381 - protein, 1291 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSKRTADGSEFEPKKKRKV

SEQ ID NO: 382 - protein, 1605 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGDSGGSKRTADGSEFEPKKKRKV

SEQ ID NO: 383 - protein, 1291 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSKRTADGSEFEPKKKRKV

SEQ ID NO: 384 - protein, 32 aa, Artificial Sequence
  Synthetic
SGGSSGGSSGSETPGTSESATPESSGGSSGGS

SEQ ID NO: 385 - protein, 1803 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLTIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSCQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGDSGGSKRTADGSEFEPKKKRKV

SEQ ID NO: 386 - protein, 1786 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 387 - protein, 1803 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSKRTADGSEFEPKKKRKV

SEQ ID NO: 388 - protein, 1605 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

SEQ ID NO: 389 - DNA, 142 bp, Artificial Sequence
  Synthetic
ttgcccactccctctatgcgcgctcgctcgctcggtggggcctgcggaccaaaggtccgcagacggcagagctctgctctgccggccccaccgagcgagcgagcgcgcatagagggagtgggcaactccatcactaggggta

SEQ ID NO: 390 - protein, 31 aa, Artificial Sequence
  Synthetic
  misc_feature (2)..(31): may be absent
GGGGGGGGGGGGGGGGGGGGGGGGGGGGGGG

SEQ ID NO: 391 - protein, 40 aa, Artificial Sequence
  Synthetic
SGGSSGGSSGSETPGTSESATPESSGGSSGGSSGGSSGGS

SEQ ID NO: 392 - protein, 64 aa, Artificial Sequence
  Synthetic
SGGSSGGSSGSETPGTSESATPESSGGSSGGSSGGSSGGSSGSETPGTSESATPESSGGSSGGS

SEQ ID NO: 393 - protein, 92 aa, Artificial Sequence
  Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 394 - protein, 1367 aa, Artificial Sequence; identical to SEQ ID NO: 25
  Synthetic

SEQ ID NO: 395 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 396 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 397 - protein, 1050 aa, Artificial Sequence
  Synthetic
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGS

SEQ ID NO: 398 - protein, 17 aa, Artificial Sequence
  Synthetic
KRTADGSEFEPKKKRKV

SEQ ID NO: 399 - protein, 1395 aa, Artificial Sequence; identical to SEQ ID NO: 367
  Synthetic

SEQ ID NO: 400 - protein, 1395 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 401 - protein, 1810 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPFSGGSPKKKRKV

SEQ ID NO: 402 - protein, 1716 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 403 - protein, 1722 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGSETPGTSESATPESTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 404 - protein, 1726 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 405 - protein, 1797 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 406 - protein, 1825 aa, Artificial Sequence
  Synthetic
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 407 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 408 - skipped

SEQ ID NO: 409 - protein, 166 aa, Artificial Sequence
  Synthetic
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 410 - protein, 166 aa, Artificial Sequence
  Synthetic
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 411 - protein, 166 aa, Artificial Sequence
  Synthetic
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 412 - protein, 166 aa, Artificial Sequence
  Synthetic
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 413 - protein, 166 aa, Artificial Sequence
  Synthetic
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 414 - protein, 166 aa, Artificial Sequence
  Synthetic
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 415 - protein, 166 aa, Artificial Sequence
  Synthetic
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 416 - protein, 166 aa, Artificial Sequence
  Synthetic
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 417 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 418 - protein, 166 aa, Artificial Sequence
  Synthetic
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 419 - protein, 166 aa, Artificial Sequence
  Synthetic
SEVEFSHEYWMRHALTLAKRAWDEREVPVGAVLVHNNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 420 - protein, 166 aa, Artificial Sequence
  Synthetic
SEVEFSHEYWMRHALTLAKRAWDAGEVPVGAVLVHNNRVIGEGWNRPIGRHDPTAHAEIMALRQGGLVMQNYRLIDATLYVTFEPCVMCAGAMIHSRIGRVVFGVNNAKTGAAGSLMDVLHYPGMNHRVEITEGILADECNELLSYFFRMRRQVFKAQKKAQSSTD

SEQ ID NO: 421 - skipped

SEQ ID NO: 422 - protein, 166 aa, Artificial Sequence
  Synthetic
SEVEFSHEYWMRHALTLAKRAWDEREVPVGAVLVHTNRVIGEGWNRTIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 423 - protein, 166 aa, Artificial Sequence
  Synthetic
SEVEFSHEYWMRHALTLAKRAWDEREVPVGAVLVHSNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 424 - protein, 166 aa, Artificial Sequence
  Synthetic
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 425 - skipped

SEQ ID NO: 426 - protein, 166 aa, Artificial Sequence
  Synthetic
SEVEFSHEYWMRHALTLAKRAWDEREVPVGAVLVLNNRVIGEGWNRLIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 427 - protein, 166 aa, Artificial Sequence
  Synthetic
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 428 - protein, 166 aa, Artificial Sequence
  Synthetic
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFKAQKKAQSSTD

SEQ ID NO: 429 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLRYFFRMRRQVFKAQKKAQSSTD

SEQ ID NO: 430 - protein, 166 aa, Artificial Sequence
  Synthetic
SEVEFSHEYWMRHALTLAKRAWDEREVPVGAVLVHSNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 431 - protein, 166 aa, Artificial Sequence
  Synthetic
SEVEFSHEYWMRHALTLAKRAWDEREVPVGAVLVHNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 432 - skipped

SEQ ID NO: 433 - protein, 159 aa, Artificial Sequence
  Synthetic
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADNPKGGCSGSLMNLLQQSNFNHRAIVDKGVLKEACSTLLTTFFKNLRANKKSTN

SEQ ID NO: 434 - protein, 159 aa, Artificial Sequence
  Synthetic
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 435 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGD

SEQ ID NO: 436 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTINRKQYNTTKEVLDATLIRQSITGLYETRIDLSQLGGD

SEQ ID NO: 437 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGD

SEQ ID NO: 438 - protein, 166 aa, Artificial Sequence
  Synthetic
SEVEFSHEYWMRHALTLAKRAWDEREVPVGAVLVHNNRVIGEGWNRSIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 439 - protein, 166 aa, Artificial Sequence
  Synthetic
SEVEFSHEYWMRHALTLAKRAWDEREVPVGAVLVHNNRVIGEGWNRTIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 440 - protein, 166 aa, Artificial Sequence
  Synthetic
SEVEFSHEYWMRHALTLAKRAWDEREVPVGAVLVHNNRVIGEGWNRAIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 441 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECNALLSDFFRMRRQEIKAQKKAQSSTD

SEQ ID NO: 442 - protein, 166 aa, Artificial Sequence
  Synthetic
SEVEFSHEYWMRHALTLAKRARDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 443 - protein, 166 aa, Artificial Sequence
  Synthetic
SEVEFSHEYWMRHALTLAKRALDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 444 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMPRQEIKAQKKAQSSTD

SEQ ID NO: 445 - protein, 166 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMHRQEIKAQKKAQSSTD

SEQ ID NO: 446 - protein, 166 aa, E. coli
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 447 - protein, 166 aa, Artificial Sequence
  Synthetic
SEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 448 - protein, 166 aa, Artificial Sequence
  Synthetic
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 449 - protein, 166 aa, Artificial Sequence
  Synthetic
SEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 450 - protein, 166 aa, Artificial Sequence
  Synthetic
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 451 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 452 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 453 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 454 - protein, 164 aa, S. putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 455 - protein, 173 aa, H. influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 456 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 457 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 458 - protein, 1774 aa, Artificial Sequence
  Synthetic
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 459 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 460 - protein, 1767 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 461 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 462 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 463 - protein, 1767 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 464 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 465 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 466 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 467 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 468 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 469 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 470 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 471 - protein, 1775 aa, Artificial Sequence; identical to SEQ ID NO: 468
  Synthetic

SEQ ID NO: 472 - protein, 1767 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 473 - protein, 1767 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 474 - protein, 1767 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 475 - protein, 1775 aa, Artificial Sequence; identical to SEQ ID NO: 464
  Synthetic

SEQ ID NO: 476 - protein, 1775 aa, Artificial Sequence; identical to SEQ ID NO: 469
  Synthetic

SEQ ID NO: 477 - protein, 1775 aa, Artificial Sequence; identical to SEQ ID NO: 470
  Synthetic

SEQ ID NO: 478 - protein, 1775 aa, Artificial Sequence; identical to SEQ ID NO: 468
  Synthetic

SEQ ID NO: 479 - protein, 166 aa, Artificial Sequence; identical to SEQ ID NO: 450
  Synthetic

SEQ ID NO: 480 - protein, 1775 aa, Artificial Sequence; identical to SEQ ID NO: 465
  Synthetic

SEQ ID NO: 481 - DNA, 20 bp, Artificial Sequence
  Synthetic
gacctttggtcgcccggcct

SEQ ID NO: 482 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 483 - protein, 1800 aa, Artificial Sequence
  Synthetic
MKRTADGSEFESPKKKRKVMSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRTADGSEFEPKKKRKV

SEQ ID NO: 484 - DNA, 22 bp, Artificial Sequence
  Synthetic
gagttggccactccctctctgc

SEQ ID NO: 485 - DNA, 20 bp, Artificial Sequence
  Synthetic
agaacggcatcaaggtgaac

SEQ ID NO: 486 - DNA, 20 bp, Artificial Sequence
  Synthetic
gaactccagcaggaccatgt

SEQ ID NO: 487 - protein, 208 aa, Artificial Sequence
  Synthetic
MTDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 488 - protein, 1368 aa, S. pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 489 - protein, 1794 aa, Artificial Sequence
  Synthetic
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 490 - protein, 1804 aa, Artificial Sequence
  Synthetic
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 491 - protein, 171 aa, S. pyogenes
MPYSLEEQTYFMQEALKEAEKSLQKAEIPIGCVIVKDGEIIGRGHNAREESNQAIMHAEIMAINEANAHEGNWRLLDTTLFVTIEPCVMCSGAIGLARIPHVIYGASNQKFGGADSLYQILTDERLNHRVQVERGLLAADCANIMQTFFRQGRERKKIAKHLIKEQSDPFD

SEQ ID NO: 492 - protein, 166 aa, Artificial Sequence
  Synthetic
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 493 - protein, 166 aa, E. coli
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNAKTGAAGSLMDVLHYPGMNHRVEITEGILADECAALLCYFFRMPRQVFNAQKKAQSSTD

SEQ ID NO: 494 - protein, 166 aa, E. coli
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 495 - protein, 166 aa, E. coli
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNSKRGAAGSLMNVLNYPGMNHRVEITEGILADECAALLCDFYRMPRQVFNAQKKAQSSIN

SEQ ID NO: 496 - DNA, 49 bp, Artificial Sequence
  Synthetic
tggagttcagacgtgtgctcttccgatctcactgaaacttgccatcgcc

SEQ ID NO: 497 - DNA, 58 bp, Artificial Sequence
  Synthetic
  misc_feature (34)..(37): n is a, c, g, or t
acactctttccctacacgacgctcttccgatctnnnntctgaacaggttagagggtgc

SEQ ID NO: 498 - DNA, 51 bp, Artificial Sequence
  Synthetic
tggagttcagacgtgtgctcttccgatctaattcctaagttccagggagtc

SEQ ID NO: 499 - DNA, 60 bp, Artificial Sequence
  Synthetic
  misc_feature (34)..(37): n is a, c, g, or t
acactctttccctacacgacgctcttccgatctnnnngctcattctaaaattcatagcct

SEQ ID NO: 500 - DNA, 49 bp, Artificial Sequence
  Synthetic
tggagttcagacgtgtgctcttccgatcttagcatgctgggaaccagac

SEQ ID NO: 501 - DNA, 57 bp, Artificial Sequence
  Synthetic
  misc_feature (34)..(37): n is a, c, g, or t
acactctttccctacacgacgctcttccgatctnnnnaggtcctagggtcattcggg

SEQ ID NO: 502 - DNA, 49 bp, Artificial Sequence
  Synthetic
tggagttcagacgtgtgctcttccgatctagtagccttcagctgccaac

SEQ ID NO: 503 - DNA, 57 bp, Artificial Sequence
  Synthetic
  misc_feature (34)..(37): n is a, c, g, or t
acactctttccctacacgacgctcttccgatctnnnngcctctgactgtgtggcaag

SEQ ID NO: 504 - DNA, 51 bp, Artificial Sequence
  Synthetic
tggagttcagacgtgtgctcttccgatctacattgccttctccactcttcc

SEQ ID NO: 505 - DNA, 58 bp, Artificial Sequence
  Synthetic
  misc_feature (34)..(37): n is a, c, g, or t
acactctttccctacacgacgctcttccgatctnnnnaccagggcatgtcatgaaaac

SEQ ID NO: 506 - DNA, 49 bp, Artificial Sequence
  Synthetic
tggagttcagacgtgtgctcttccgatctcaggagcacacctatcaggc

SEQ ID NO: 507 - DNA, 59 bp, Artificial Sequence
  Synthetic
  misc_feature (34)..(37): n is a, c, g, or t
acactctttccctacacgacgctcttccgatctnnnnactagagccactaggaagaggg

SEQ ID NO: 508 - DNA, 49 bp, Artificial Sequence
  Synthetic
tggagttcagacgtgtgctcttccgatctttctagcttgctcctgggct

SEQ ID NO: 509 - DNA, 38 bp, Artificial Sequence
  Synthetic
ccacctgaggaataggaagtacgaggccactgaggaac

SEQ ID NO: 510 - DNA, 38 bp, Artificial Sequence
  Synthetic
ccacctgaggaataggaagtatgaggccactgaggaac

SEQ ID NO: 511 - DNA, 38 bp, Artificial Sequence
  Synthetic
ccacctgaggaacaggaagtacgaggccactgaggaac

SEQ ID NO: 512 - DNA, 38 bp, Artificial Sequence
  Synthetic
ccacctgaggaacaggaagtatgaggccactgaggaac

SEQ ID NO: 513 - DNA, 20 bp, Artificial Sequence
  Synthetic
aacaggaagcacgaggccac

SEQ ID NO: 514 - protein, 159 aa, Artificial Sequence
  Synthetic
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 515 - protein, 1853 aa, Artificial Sequence
  Synthetic
MKRTADGSEFESPKKKRKVSSETGPVAVDPTLRRRIEPHEFEVFFDPRELRKETCLLYEIKWGTSHKIWRHSSKNTTKHVEVNFIEKFTSERHFCPSTSCSITWFLSWSPCGECSKAITEFLSQHPNVTLVIYVARLYHHMDQQNRQGLRDLVNSGVTIQIMTAPEYDYCWRNFVNYPPGKEAHWPRYPPLWMKLYALELHAGILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 516 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSYSPCGECSRAITEFLSRYPHVTLFIYIARLYHHADPENRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 517 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSYSPCGECSRAITEFLSRYPHVTLFIYIARLYHHADPRNRQGLEDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 518 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSYSPCGECSRAITEFLSRYPHVTLFIYIARLYHHADPENRQGLEDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 519 - protein, 1082 aa, Geobacillus thermodenitrificans
MKYKIGLDIGITSIGWAVINLDIPRIEDLGVRIFDRAENPKTGESLALPRRLARSARRRLRRRKHRLERIRRLFVREGILTKEELNKLFEKKHEIDVWQLRVEALDRKLNNDELARILLHLAKRRGFRSNRKSERTNKENSTMLKHIEENQSILSSYRTVAEMVVKDPKFSLHKRNKEDNYTNTVARDDLEREIKLIFAKQREYGNIVCTEAFEHEYISIWASQRPFASKDDIEKKVGFCTFEPKEKRAPKATYTFQSFTVWEHINKLRLVSPGGIRALTDDERRLIYKQAFHKNKITFHDVRTLLNLPDDTRFKGLLYDRNTTLKENEKVRFLELGAYHKIRKAIDSVYGKGAAKSFRPIDFDTFGYALTMFKDDTDIRSYLRNEYEQNGKRMENLADKVYDEELIEELLNLSFSKFGHLSLKALRNILPYMEQGEVYSTACERAGYTFTGPKKKQKTVLLPNIPPIANPVVMRALTQARKVVNAIIKKYGSPVSIHIELARELSQSFDERRKMQKEQEGNRKKNETAIRQLVEYGLTLNPTGLDIVKFKLWSEQNGKCAYSLQPIEIERLLEPGYTEVDHVIPYSRSLDDSYTNKVLVLTKENREKGNRTPAEYLGLGSERWQQFETFVLTNKQFSKKKRDRLLRLHYDENEENEFKNRNLNDTRYISRFLANFIREHLKFADSDDKQKVYTVNGRITAHLRSRWNFNKNREESNLHHAVDAAIVACTTPSDIARVTAFYQRREQNKELSKKTDPQFPQPWPHFADELQARLSKNPKESIKALNLGNYDNEKLESLQPVFVSRMPKRSITGAAHQETLRRYIGIDERSGKIQTVVKKKLSEIQLDKTGHFPMYGKESDPRTYEAIRQRLLEHNNDPKKAFQEPLYKPKKNGELGPIIRTIKIIDTTNQVIPLNDGKTVAYNSNIVRVDVFEKDGKYYCVPIYTIDMMKGILPNKAIEPNKPYSEWKEMTEDYTFRFSLYPNDLIRIEFPREKTIKTAVGEEIKIKDLFAYYQTIDSSNGGLSLVSHDNNFSLRSIGSRTLKRFEKYQVDVLGNIYKVRGEKRVGVASSSHSKAGETIRPL

SEQ ID NO: 520 - protein, 1375 aa, S. Canis; identical to SEQ ID NO: 113

SEQ ID NO: 521 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNHQSASNRQRQALLLIYTPSTNKAVEKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQRMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWNKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSKKAFLKQKISPQFTKVKKQKGTIVKVVEDFEVIAPHILINQRFFDNGQELTLGSATYKHNEQELILDKTAVKLLNGALPLTQSEELAEQVYDEILDQVMHYFPLYDTNQFRAKLSAGKAAFMKLPWKSQWDGNKMVQVGQQVILDRVLIGLHANAAVSDLGVLKISTPLGKMQQPSGISLSPDTQIIYQSPTGLFERRVALRDL

SEQ ID NO: 522 - protein, 1356 aa, Lactobacillus farciminis
MTKKEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTLDKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNYSVLDLMWTTNNNFISIISNDKYDFKNYIENHNLNKNEDQNISNLVNDIHVSPALKRGITQSIKIVQEIVKFMGHAPKYIFIEVTRETKKSEITTSRGKRIQRLQSKLLNKANGFKPQLRKYLVPNEKIQEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALSDQDDRYHFKHPELVKNRNINDFHHAQDAYLASFLGTYRLRRFPTDEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREIANRQQLILPPEHSALLRILQIPDEDPDQILAFYDKNILVEILQELITKMKKFYPFYKNEQEFLASNIENFNQATTSEKINSLEELITLLHANSTSAHLIFNNIEKKAFGRKTHGLTLNDTDFIYQSVTGLYETRIHIE

SEQ ID NO: 523 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 524 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 525 - protein, 1337 aa, Unknown
  Listeria innocua ATCC 33091
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 526 - protein, 1103 aa, Unknown
  Listeria innocua FSL S4-378
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 527 - protein, 1334 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIEEGSLTRLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGKTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 528 - protein, 953 aa, Unknown
  Listeria ivanovii FSL F6-596
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 529 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 530 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 531 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 532 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 533 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 534 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 535 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 536 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 537 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 538 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 539 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 540 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 541 - protein, 782 aa, Unknown
  Listeria monocytogenes FSL F2-208
  misc_feature (722)..(722): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 542 - protein, 1334 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIEEGSLTRIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGKTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 543 - protein, 1400 aa, Unknown
  Plant multiplex genome editing vector pYLCRISPR/Cas9Pubi-H
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 544 - protein, 1333 aa, Roseburia hominis
MSQNIVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDVFTQFADFNNIPYEDDEKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRPNKAPVDEFYKFVKKCIEKVDTPEAKQILHDIELENFLLKQNSRTNGSVPYQMQLDEMIKIIDNQAKYYPVLKEKREQLLSILTFRIPYYFGPLNETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADNRFGSSVTVLDVLEMSRLNLMEIINDKELGYAQMIEEASSCPKDGKFTYEEVAKLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKKWKDGFVINSMNYPYEVDGKLIWNPDLINEIKKCFYYKDCYCTTKLDQKSGQMFNLTVLPNDAHSAKGTTEAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSPTECVNAMQLVLNEEQCKLIADIYNAIYKQDFDGLDNMLMIQLYLQLIDKLKTLYPIYMGIVEKFEKLTEDFVSISKEEKANVIKQMLIIMHKGPQNGNIIYDDFNVGKRIGRLNGRTFYLDNIEFISQSPTGIYTKKYKL

SEQ ID NO: 545 - protein, 1335 aa, Sharpea azabuensis
MAKNKDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGNDYKDNYNLFIEKDFNDKTYYDKYPTIYHLRKELCENKEKADPRLIYLALHHIVKYRGNFLYEGQSFTMDNSDIEERLNSAIEKFMSINEFDNRIVESDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYPKDTPVEEFYKYIKGLLAKVDTDEAREILERIDLEKFMLKQNSRTNGSIPYQMQKDEMIQIIDNQSVYYPQLKENRDKLISILEFRIPYYFGPLNAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADNEFGSKATVLFVLENSNKNLMEIINDEKLGYKQIIEESNMQDIEGPFKYDEVKKLAGSPAIKRGIWQALLVVREITKFMKHEPSHIYIEFAREEQEKVRKESKIAKLQKIYENLNLQTKEDQQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKDVKHHNNYGFILNSMNHLQSDIDTGEVMWDPAKIGKIKSCFYYKDVYVTKKLEQNSGTLFNVTVLPNDAHSEKGITAATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSPTEYVTARQLSLNEQSCKLISEIYAAMLKKRYEYLDEEEIFDLYLQLLQKMDTLYPAYKGIAKRFFDRAEDFKNIDVVEKCDVIKQILIIMHAGPMNGNIMYDDFKFTNRIGRFTHKNIDLNKTTFISTSVTGLFSKKYKL

SEQ ID NO: 546 - protein, 1417 aa, Artificial Sequence
  Synthetic
MDYKDDDDKDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 547 - protein, 1368 aa, Artificial Sequence
  Synthetic
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 548 - protein, 1376 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPPKKKRKV

SEQ ID NO: 549 - protein, 1372 aa, Artificial Sequence
  Synthetic
GAASMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 550 - protein, 1853 aa, Artificial Sequence
  Synthetic
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPENRQGLEDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 551 - protein, 1853 aa, Artificial Sequence
  Synthetic
MKRTADGSEFESPKKKRKVSSETGPVAVDPTLRRRIEPHEFEVFFDPRELAKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 552 - protein, 1853 aa, Artificial Sequence
  Synthetic
MKRTADGSEFESPKKKRKVSSETGPVAVDPTLRRRIEPHEFEVFFDPRELAAETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 553 - protein, 1803 aa, Artificial Sequence
  Synthetic
MKRTADGSEFESPKKKRKVSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLTIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSCQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGDSGGSKRTADGSEFEPKKKRKV

SEQ ID NO: 554 - protein, 1368 aa, Artificial Sequence
  Synthetic
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESIRPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIDRKVYRSTKEVLDATLIHQSITGLYETRIDLSQLGGD

SEQ ID NO: 555 - protein, 1054 aa, Artificial Sequence
  Synthetic
MGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 556 - protein, 1368 aa, Artificial Sequence
  Synthetic
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNTEITKAPLSASMIKLYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQEDFYPFLKDNREKIEKILTFRIPYYVGPLARGNSRFAWMTRKSEETITPWNFEKVVDKGASAQSFIERMTNFDKNLPNEKVLPKHSLLYEYFTVYNELTKVKYVTEGMRKPAFLSGDQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFIQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 557 - protein, 124 aa, Artificial Sequence
  Synthetic
  misc_feature (5)..(124): may be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 558 - protein, 124 aa, Artificial Sequence
  Synthetic
  misc_feature (5)..(124): may be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 559 - protein, 155 aa, Artificial Sequence
  Synthetic
  misc_feature (6)..(155): may be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 560 - protein, 155 aa, Artificial Sequence
  Synthetic
  misc_feature (6)..(155): may be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 561 - protein, 24 aa, Artificial Sequence
  Synthetic
SGGSSGSETPGTSESATPESSGGS

SEQ ID NO: 562 - protein, 93 aa, Artificial Sequence
  Synthetic
  misc_feature (4)..(93): may be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 563 - protein, 62 aa, Artificial Sequence
  Synthetic
  misc_feature (1)..(1): Xaa can be any naturally occurring amino acid
  misc_feature (3)..(62): may be absent
XPXPXPXPXPXPXPXPXPXPXPXPXPXPXPXPXPXPXPXPXPXPXPXPXPXPXPXPXPXPXP

SEQ ID NO: 564 - protein, 104 aa, Artificial Sequence
  Synthetic
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 565 - RNA, 91 nt, Artificial Sequence
  Synthetic
guuuuaguacucuguaaugaaaauuacagaaucuacuaaaacaaggcaaaaugccguguuuaucucgucaacuuguuggcgagauuuuuuu

SEQ ID NO: 566 - RNA, 21 nt, Artificial Sequence
  Synthetic
uaauuucuacuaaguguagau

SEQ ID NO: 567 - RNA, 20 nt, Artificial Sequence
  Synthetic
uaauuucuacucuuguagau

SEQ ID NO: 568 - RNA, 97 nt, S. thermophilus
guuuuagagcuguguuguuuguuaaaacaacacagcgaguuaaaauaaggcuuaguccguacucaacuugaaaagguggcaccgauucgguguuuuu

SEQ ID NO: 569 - RNA, 95 nt, F. novicida
aucuaaaauuauaaauguaccaaauaauuaaugcucuguaaucauuuaaaaguauuuugaacggaccucuguuugacacgucugaauaacuaaaa

SEQ ID NO: 570 - RNA, 109 nt, S. thermophilus
uguaagggacgccuuacacaguuacuuaaaucuugcagaagcuacaaagauaaggcuucaugccgaaaucaacacccugucauuuuauggcaggguguuuucguuauuu

SEQ ID NO: 571 - RNA, 92 nt, L. innocua
auuguuaguauucaaaauaacauagcaaguuaaaauaaggcuuuguccguuaucaacuuuuaauuaaguagcgcuguuucggcgcuuuuuuu

SEQ ID NO: 572 - RNA, 107 nt, S. mutans
guuggaaucauucgaaacaacacagcaaguuaaaauaaggcagugauuuuuaauccaguccguacacaacuugaaaaagugcgcaccgauucggugcuuuuuuauuu

SEQ ID NO: 573 - RNA, 96 nt, S. thermophilus
uugugguuugaaaccauucgaaacaacacagcgaguuaaaauaaggcuuaguccguacucaacuugaaaagguggcaccgauucgguguuuuuuuu

SEQ ID NO: 574 - RNA, 102 nt, N. meningitidis
acauauugucgcacugcgaaaugagaaccguugcuacaauaaggccgucugaaaagaugugccgcaacgcucugccccuuaaagcuucugcuuuaaggggca

SEQ ID NO: 575 - RNA, 110 nt, P. multocida
gcauauuguugcacugcgaaaugagagacguugcuacaauaaggcuucugaaaagaaugaccguaacgcucugccccuugugauucuuaauugcaaggggcaucguuuuu

SEQ ID NO: 576 - DNA, 145 bp, Artificial Sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 577 - DNA, 146 bp, Artificial Sequence
  Synthetic
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggc

SEQ ID NO: 578 - DNA, 167 bp, Artificial Sequence
  Synthetic
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaagggggttttgta

SEQ ID NO: 579 - DNA, 52 bp, Artificial Sequence
  Synthetic
tggagttcagacgtgtgctcttccgatctcccttattggaagtcagggctta

SEQ ID NO: 580 - DNA, 59 bp, Artificial Sequence
  Synthetic
  misc_feature (34)..(37): n is a, c, g, or t
acactctttccctacacgacgctcttccgatctnnnnggaggatcactaagagaaggct

SEQ ID NO: 581 - DNA, 57 bp, Artificial Sequence
  Synthetic
  misc_feature (34)..(37): n is a, c, g, or t
acactctttccctacacgacgctcttccgatctnnnnaatgaaggcgctcttgggaa

SEQ ID NO: 582 - DNA, 49 bp, Artificial Sequence
  Synthetic
tggagttcagacgtgtgctcttccgatctcgtacggtaaaccccagagg

SEQ ID NO: 583 - DNA, 53 bp, Artificial Sequence
  Synthetic
  misc_feature (34)..(37): n is a, c, g, or t
acactctttccctacacgacgctcttccgatctnnnnggtgtccgcctggctc

SEQ ID NO: 584 - DNA, 49 bp, Artificial Sequence
  Synthetic
tggagttcagacgtgtgctcttccgatctcacctgtcctctggtctgga

SEQ ID NO: 585 - DNA, 57 bp, Artificial Sequence
  Synthetic
  misc_feature (34)..(37): n is a, c, g, or t
acactctttccctacacgacgctcttccgatctnnnnacaaaagaagggggagcgac

SEQ ID NO: 586 - DNA, 49 bp, Artificial Sequence
  Synthetic
tggagttcagacgtgtgctcttccgatcttgcacagcataaaagggtgc

SEQ ID NO: 587 - DNA, 57 bp, Artificial Sequence
  Synthetic
  misc_feature (34)..(37): n is a, c, g, or t
acactctttccctacacgacgctcttccgatctnnnnggcaaggggcatccttatgt

SEQ ID NO: 588 - protein, 10 aa, Artificial Sequence
  Synthetic
RLTASNITET

SEQ ID NO: 589 - protein, 10 aa, Artificial Sequence
  Synthetic
RLIASNITET

SEQ ID NO: 590 - DNA, 30 bp, Artificial Sequence
  Synthetic
cggctaacagccagtaacatcacggaaacc

SEQ ID NO: 591 - DNA, 30 bp, Artificial Sequence
  Synthetic
cggctaatagccagtaacatcacggaaacc

SEQ ID NO: 592 - DNA, 16 bp, Artificial Sequence
  Synthetic
gatgttccaatcagta

SEQ ID NO: 593 - DNA, 16 bp, Artificial Sequence
  Synthetic
tctgcttctccagccc

SEQ ID NO: 594 - DNA, 16 bp, Artificial Sequence
  Synthetic
acgtgctcagtctggg

SEQ ID NO: 595 - DNA, 16 bp, Artificial Sequence
  Synthetic
gcgaggcagagggtcc

SEQ ID NO: 596 - DNA, 16 bp, Artificial Sequence
  Synthetic
ccactgtagtcacaca

SEQ ID NO: 597 - DNA, 16 bp, Artificial Sequence
  Synthetic
gtggcactgcggctgg

SEQ ID NO: 598 - DNA, 25 bp, Artificial Sequence
  Synthetic
caccgcgggctggagctgttcgcgc

SEQ ID NO: 599 - DNA, 25 bp, Artificial Sequence
  Synthetic
aaacgcgcgaacagctccagcccgc

SEQ ID NO: 600 - DNA, 24 bp, Artificial Sequence
  Synthetic
caccgctaacagccagtaacatca

SEQ ID NO: 601 - DNA, 24 bp, Artificial Sequence
  Synthetic
aaactgatgttactggctgttagc

SEQ ID NO: 602 - DNA, 25 bp, Artificial Sequence
  Synthetic
caccgaacagctctgaacgagaccc

SEQ ID NO: 603 - DNA, 25 bp, Artificial Sequence
  Synthetic
aaacgggtctcgttcagagctgttc

SEQ ID NO: 604 - DNA, 26 bp, Artificial Sequence
  Synthetic
caccgccaccgcagccacgcagagca

SEQ ID NO: 605 - DNA, 26 bp, Artificial Sequence
  Synthetic
aaactgctctgcgtggctgcggtggc

SEQ ID NO: 606 - DNA, 57 bp, Artificial Sequence
  Synthetic
  misc_feature (34)..(37): n is a, c, g, or t
acactctttccctacacgacgctcttccgatctnnnnccttcgggcatagcatggtc

SEQ ID NO: 607 - DNA, 50 bp, Artificial Sequence
  Synthetic
tggagttcagacgtgtgctcttccgatcttatatgcctcggcatcggtcc

SEQ ID NO: 608 - DNA, 58 bp, Artificial Sequence
  Synthetic
  misc_feature (34)..(37): n is a, c, g, or t
acactctttccctacacgacgctcttccgatctnnnnggggacatgctgcttacggtt

SEQ ID NO: 609 - DNA, 50 bp, Artificial Sequence
  Synthetic
tggagttcagacgtgtgctcttccgatcttggcccgctcacctcaaatgc

SEQ ID NO: 610 - DNA, 58 bp, Artificial Sequence
  Synthetic
  misc_feature (34)..(37): n is a, c, g, or t
acactctttccctacacgacgctcttccgatctnnnngccggggtctcgttcagagct

SEQ ID NO: 611 - DNA, 49 bp, Artificial Sequence
  Synthetic
tggagttcagacgtgtgctcttccgatctctaccgcctgcggacatggt

SEQ ID NO: 612 - DNA, 57 bp, Artificial Sequence
  Synthetic
  misc_feature (34)..(37): n is a, c, g, or t
acactctttccctacacgacgctcttccgatctnnnncagctcagcctgagtgttga

SEQ ID NO: 613 - DNA, 48 bp, Artificial Sequence
  Synthetic
tggagttcagacgtgtgctcttccgatctctcgtgggtttgtggttgc

SEQ ID NO: 614 - DNA, 57 bp, Artificial Sequence
  Synthetic
  misc_feature (34)..(37): n is a, c, g, or t
acactctttccctacacgacgctcttccgatctnnnncattgcagagaggcgtatca

SEQ ID NO: 615 - DNA, 47 bp, Artificial Sequence
  Synthetic
tggagttcagacgtgtgctcttccgatctggggtcccaggtgctgac

SEQ ID NO: 616 - DNA, 57 bp, Artificial Sequence
  Synthetic
  misc_feature (34)..(37): n is a, c, g, or t
acactctttccctacacgacgctcttccgatctnnnnccagccccatctgtcaaact

SEQ ID NO: 617 - DNA, 54 bp, Artificial Sequence
  Synthetic
tggagttcagacgtgtgctcttccgatcttgaatggattccttggaaacaatga

SEQ ID NO: 618 - DNA, 57 bp, Artificial Sequence
  Synthetic
  misc_feature (34)..(37): n is a, c, g, or t
acactctttccctacacgacgctcttccgatctnnnnatgtgggctgcctagaaagg

SEQ ID NO: 619 - DNA, 49 bp, Artificial Sequence
  Synthetic
tggagttcagacgtgtgctcttccgatctcccagccaaacttgtcaacc

SEQ ID NO: 620 - DNA, 57 bp, Artificial Sequence
  Synthetic
  misc_feature (34)..(37): n is a, c, g, or t
acactctttccctacacgacgctcttccgatctnnnngaacccaggtagccagagac

SEQ ID NO: 621 - DNA, 49 bp, Artificial Sequence
  Synthetic
tggagttcagacgtgtgctcttccgatcttcctttcaacccgaacggag

SEQ ID NO: 622 - DNA, 57 bp, Artificial Sequence
  Synthetic
  misc_feature (34)..(37): n is a, c, g, or t
acactctttccctacacgacgctcttccgatctnnnnacgtctcatatgccccttgg

SEQ ID NO: 623 - DNA, 51 bp, Artificial Sequence
  Synthetic
tggagttcagacgtgtgctcttccgatctacgtaggaattttggtgggaca

SEQ ID NO: 624 - DNA, 57 bp, Artificial Sequence
  Synthetic
  misc_feature (34)..(37): n is a, c, g, or t
acactctttccctacacgacgctcttccgatctnnnnggcgtccatgtccttcccga

SEQ ID NO: 625 - DNA, 51 bp, Artificial Sequence
  Synthetic
tggagttcagacgtgtgctcttccgatctacatgtgcggcctcatcagcca

SEQ ID NO: 626 - DNA, 60 bp, Artificial Sequence
  Synthetic
  misc_feature (34)..(37): n is a, c, g, or t
acactctttccctacacgacgctcttccgatctnnnnagaacaatggggatggggaggtt

SEQ ID NO: 627 - DNA, 50 bp, Artificial Sequence
  Synthetic
tggagttcagacgtgtgctcttccgatctctcagtggcctcgtacttcct

SEQ ID NO: 628 - DNA, 59 bp, Artificial Sequence
  Synthetic
  misc_feature (34)..(37): n is a, c, g, or t
acactctttccctacacgacgctcttccgatctnnnnggcagggcttccagtcctcatt

SEQ ID NO: 629 - DNA, 54 bp, Artificial Sequence
  Synthetic
tggagttcagacgtgtgctcttccgatctgtgctcattctgggctctttttggc

SEQ ID NO: 630 - DNA, 59 bp, Artificial Sequence
  Synthetic
  misc_feature (34)..(37): n is a, c, g, or t
acactctttccctacacgacgctcttccgatctnnnncccggccccacctatactcaaa

SEQ ID NO: 631 - DNA, 50 bp, Artificial Sequence
  Synthetic
tggagttcagacgtgtgctcttccgatctgcttgctgcgctagccttcat

SEQ ID NO: 632 - DNA, 57 bp, Artificial Sequence
  Synthetic
  misc_feature (34)..(37): n is a, c, g, or t
acactctttccctacacgacgctcttccgatctnnnnctacccagggagattcatgc

SEQ ID NO: 633 - DNA, 50 bp, Artificial Sequence
  Synthetic
tggagttcagacgtgtgctcttccgatcttggactgaacctctgaacctg

SEQ ID NO: 634 - DNA, 60 bp, Artificial Sequence
  Synthetic
  misc_feature (34)..(37): n is a, c, g, or t
acactctttccctacacgacgctcttccgatctnnnntgcacactctgtggagaactggt

SEQ ID NO: 635 - DNA, 54 bp, Artificial Sequence
  Synthetic
tggagttcagacgtgtgctcttccgatctagtgtgtccatgtgatttgaatgct

SEQ ID NO: 636 - DNA, 57 bp, Artificial Sequence
  Synthetic
  misc_feature (34)..(37): n is a, c, g, or t
acactctttccctacacgacgctcttccgatctnnnnggccagccttcatccttggc

SEQ ID NO: 637 - DNA, 49 bp, Artificial Sequence
  Synthetic
tggagttcagacgtgtgctcttccgatcttgcgtggctaggtgggcttt

SEQ ID NO: 638 - DNA, 59 bp, Artificial Sequence
  Synthetic
  misc_feature (34)..(37): n is a, c, g, or t
acactctttccctacacgacgctcttccgatctnnnntctgcaacctgtgggctcaaga

SEQ ID NO: 639 - DNA, 52 bp, Artificial Sequence
  Synthetic
tggagttcagacgtgtgctcttccgatctagtcagatctctccaggggtcat

SEQ ID NO: 640 - DNA, 58 bp, Artificial Sequence
  Synthetic
  misc_feature (34)..(37): n is a, c, g, or t
acactctttccctacacgacgctcttccgatctnnnnaggtttgctgcggtattttca

SEQ ID NO: 641 - DNA, 53 bp, Artificial Sequence
  Synthetic
tggagttcagacgtgtgctcttccgatcttgtgtagtgaagaaatggaaacct

SEQ ID NO: 642 - DNA, 5020 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagagctagaaatagcaagttaaaataaggctagtccgttatcaacttgaaaaagtggcaccgagtcggtgctttttttgctagcggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaagaggactgccgatggatcagagtttgaatctcccaagaagaagaggaaagtaagctcagagactggcccagtggctgtggaccccacattaagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaattctggtggttctaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 643 - DNA, 4987 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagagctagaaatagcaagttaaaataaggctagtccgttatcaacttgaaaaagtggcaccgagtcggtgctttttttgctagcggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaagaggactgccgatggatcagagtttgaatctcccaagaagaagaggaaagtaatcaagatagctacaaggaagtatcttggcaaacaaaacgtttatgatattggagtcgaaagagatcacaactttgctctgaagaacggattcatagcttctaattgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 644 - DNA, 4830 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagactcgagaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagagctagaaatagcaagttaaaataaggctagtccgttatcaacttgaaaaagtggcaccgagtcggtgctttttttgctagcggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgtcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaattctggtggttctaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 645 - DNA, 4851 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagactcgagaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacccgagacgattaatgcgtctcggttttagagctagaaatagcaagttaaaataaggctagtccgttatcaacttgaaaaagtggcaccgagtcggtgctttttttgctagcggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaagaggactgccgatggatcagagtttgaatctcccaagaagaagaggaaagtaatcaagatagctacaaggaagtatcttggcaaacaaaacgtttatgatattggagtcgaaagagatcacaactttgctctgaagaacggattcatagcttctaattgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 646 - DNA, 4916 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgacgagattttcgagcgggagctggacctgatgagagtggataacctgcctaatagcggaggcagtaaaagaacagcagacgggagtgagtttgagcccaagaaaaagagaaaggtgtaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 647 - DNA, 5458 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtcatcaagattgctacacggaaatacctgggaaagcagaacgtgtacgacatcggcgtggagcgggatcacaacttcgccctgaagaatggctttatcgccagcaattgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaagcaccgactcggtgccactttttcaagttgataacggactagccttattttaacttgctatttctagctctaaaaccgagacgtataaacgcagaaaggcccacccgaaggtgagccagtgtgactctagtagagagcgttcaccgacaaacaacagataaaacgaaaggcccagtctttcgactgagcctttcgttttatttgatgcctggagatccttattaagcacccgtggagtgacgaccttcagcacgttcgtactgttcaacgatggtgtagtcttcgttgtgggaggtgatgtccagtttgatgtcggttttgtaagcacccggcagctgaacgggttttttagccatgtaggtggttttaacttcagcgtcgtagtgaccaccgtctttcagtttcagacgcattttgatttcacctttcagagcaccgtcttccgggtacatacgttcggtggaagcttcccaacccatggtttttttctgcataaccggaccgtcggacgggaagttggtaccacgcagtttaactttgtagatgaactcaccgtcttgcagggaggagtcctgggtaacggtaacaacaccaccgtcttcgaagttcataacacgttcccatttgaaaccttccgggaaggacagtttcaggtagtccgggatgtcagccgggtgtttaacgtaagctttggaaccgtactggaactgcggggacaggatgtcccaagcgaacggcagcggaccacctttggtaactttcagtttagcggtctgggtaccttcgtacggacgaccttcaccttcaccttcgatttcgaactcgtgaccgttaacggaaccttccatacgaactttgaaacgcatgaactctttgataacgtcttcgctactcgccatagatcctttctcctctttcagatccgtgctcagtatctctatcactgatagggatgtcaatctctatcactgatagggacgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 648 - DNA, 4882 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtctcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgacgagattttcgagcgggagctggacctgatgagagtggataacctgcctaatagcggaggcagtaaaagaacagcagacgggagtgagtttgagcccaagaaaaagagaaaggtgtaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaagcaccgactcggtgccactttttcaagttgataacggactagccttattttaacttgctatttctagctctaaaaccgagacgcattaatcgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 649 - DNA, 4849 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtcatcaagattgctacacggaaatacctgggaaagcagaacgtgtacgacatcggcgtggagcgggatcacaacttcgccctgaagaatggctttatcgccagcaattgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgacagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaagcaccgactcggtgccactttttcaagttgataacggactagccttattttaacttgctatttctagctctaaaaccgagacgcattaatcgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 650 - DNA, 4773 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtctcctcagagactgggcctgtcgccgtcgatccaaccctgcgccgccggattgaacctcacgagtttgaagtgttctttgacccccgggagctgagaaaggagacatgcctgctgtacgagatcaactggggaggcaggcactccatctggaggcacacctctcagaacacaaataagcacgtggaggtgaacttcatcgagaagtttaccacagagcggtacttctgccccaataccagatgtagcatcacatggtttctgagctggtccccttgcggagagtgtagcagggccatcaccgagttcctgtccagatatccacacgtgacactgtttatctacatcgccaggctgtatcaccacgcagacccaaggaataggcagggcctgcgcgatctgatcagctccggcgtgaccatccagatcatgacagagcaggagtccggctactgctggcggaacttcgtgaattattctcctagcaacgaggcccactggcctaggtacccacacctgtgggtgcgcctgtacgtgctggagctgtattgcatcatcctgggcctgcccccttgtctgaatatcctgcggagaaagcagccccagctgaccttctttacaatcgccctgcagtcttgtcactatcagaggctgccaccccacatcctgtgggccacaggcctgaagtctggaggatctagcggaggatcctctggcagcgagacaccaggaacaagcgagtcagcaacaccagagagcagtggcggcagcagcggcggcagcgggaagcgaaattacattctggggctggccattggcattacatcagtgggctatggcatcattgactacgagacaagggacgtgatcgacgccggcgtgagactgttcaaggaggccaacgtggagaacaatgagggccggagatccaagaggggagcaaggcgcctgaagcggagaaggcgccacagaatccagagagtgaagaagctgctgttcgattacaacctgctgaccgaccactccgagctgtctggcatcaatccttatgaggccagagtgaagggcctgtcccagaagctgtctgaggaggagtttagcgccgccctgctgcacctggcaaagaggagaggcgtgcacaacgtgaatgaggtggaggaggacaccggcaacgagctgtccacaaaggagcagatcagccgcaattccaaggccctggaggagaagtatgtggccgagctgcagctggagcggctgaagaaggatggcgaggtgaggggctccatcaatcgcttcaagacctctgactacgtgaaggaggccaagcagctgctgaaggtgcagaaggcctaccaccagctggatcagtcctttatcgatacatatatcgacctgctggagacaaggcgcacatactatgagggaccaggagagggctctcccttcggctggaaggacatcaaggagtggtacgagatgctgatgggccactgcacctattttccagaggagctgagaagcgtgaagtacgcctataacgccgatctgtacaacgccctgaatgacctgaacaacctggtcatcaccagggatgagaacgagaagctggagtactatgagaagttccagatcatcgagaacgtgttcaagcagaagaagaagcctacactgaagcagatcgccaaggagatcctggtgaacgaggaggacatcaagggctaccgcgtgacctccacaggcaagccagagttcaccaatctgaaggtgtatcacgatatcaaggacatcacagcccggaaggagatcatcgagaacgccgagctgctggatcagatcgccaagatcctgaccatctatcagagctccgaggacatccaggaggagctgaccaacctgaatagcgagctgacacaggaggagatcgagcagatcagcaatctgaagggctacaccggcacacacaacctgagcctgaaggccatcaatctgatcctggatgagctgtggcacacaaacgacaatcagatcgccatctttaaccggctgaagctggtgccaaagaaggtggacctgtcccagcagaaggagatcccaaccacactggtggacgatttcatcctgtctcccgtggtgaagcggagcttcatccagagcatcaaagtgatcaacgccatcatcaagaagtacggcctgcccaatgatatcatcatcgagctggccagggagaagaactccaaggacgcccagaagatgatcaatgagatgcagaagaggaaccgccagaccaatgagcggatcgaggagatcatcagaaccacaggcaaggagaacgccaagtacctgatcgagaagatcaagctgcacgatatgcaggagggcaagtgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgacgagattttcgagcgggagctggacctgatgagagtggataacctgcctaatagcggaggcagtaaaagaacagcagacgggagtgagtttgagcccaagaaaaagagaaaggtgtaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaatctcgccaacaagttgacgagataaacacggcattttgccttgttttagtagattctgtaattttcattacagagtactaaaaccgagacgcattaatcgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 651 - DNA, 4032 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtcatcaagattgctacacggaaatacctgggaaagcagaacgtgtacgacatcggcgtggagcgggatcacaacttcgccctgaagaatggctttatcgccagcaattgtctgtattctctggaggccatccctctggaggacctgctgaacaatccattcaactacgaggtggatcacatcatcccccggagcgtgagcttcgacaattcttttaacaataaggtgctggtgaagcaggaggagaacagcaagaagggcaataggacccctttccagtacctgtctagctccgattctaagatcagctacgagacattcaagaagcacatcctgaatctggccaagggcaagggccgcatcagcaagaccaagaaggagtacctgctggaggagcgggacatcaacagattctccgtgcagaaggacttcatcaaccggaatctggtggacaccagatacgccacacgcggcctgatgaatctgctgcggtcttatttcagagtgaacaatctggatgtgaaggtgaagagcatcaacggcggcttcacctcctttctgcggagaaagtggaagtttaagaaggagcgcaacaagggctataagcaccacgccgaggatgccctgatcatcgccaatgccgacttcatctttaaggagtggaagaagctggacaaggccaagaaagtgatggagaaccagatgttcgaggagaagcaggccgagagcatgcccgagatcgagacagagcaggagtacaaggagattttcatcacacctcaccagatcaagcacatcaaggacttcaaggactacaagtattctcacagggtggataagaagcccaaccgcgagctgatcaatgacaccctgtatagcacacggaaggacgataagggcaataccctgatcgtgaacaatctgaacggcctgtacgacaaggataatgacaagctgaagaagctgatcaacaagtctcccgagaagctgctgatgtaccaccacgatcctcagacatatcagaagctgaagctgatcatggagcagtacggcgacgagaagaacccactgtataagtactatgaggagacaggcaactacctgacaaagtatagcaagaaggataatggccccgtgatcaagaagatcaagtactatggcaacaagctgaatgcccacctggacatcaccgacgattaccctaactctcgcaataaggtggtgaagctgagcctgaagccataccggttcgacgtgtacctggacaacggcgtgtataagtttgtgacagtgaagaatctggatgtgatcaagaaggagaactactatgaggtgaacagcaagtgctacgaggaggccaagaagctgaagaagatcagcaaccaggccgagttcatcgcctctttttacaacaatgacctgatcaagatcaatggcgagctgtatagagtgatcggcgtgaacaatgatctgctgaacagaatcgaagtgaatatgatcgacatcacctacagggagtatctggagaacatgaatgataagaggccccctcgcatcatcaagaccatcgcctctaagacacagagcatcaagaagtacagcacagacatcctggggaacctgtatgaagtcaagagcaagaaacatcctcagattatcaagaaaggcagcggcgggagcggcgggagcggggggagcactaatctgagcgacatcattgagaaggagactgggaaacagctggtcattcaggagtccatcctgatgctgcctgaggaggtggaggaagtgatcggcaacaagccagagtctgacatcctggtgcacaccgcctacgacgagtccacagatgagaatgtgatgctgctgacctctgacgcccccgagtataagccttgggccctggtcatccaggattctaacggcgagaataagatcaagatgctgagcggaggatccaaaagaaccgccgacggcagcgaattcgagcccaagaagaagaggaaagtctaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaatctcgccaacaagttgacgagataaacacggcattttgccttgttttagtagattctgtaattttcattacagagtactaaaaccgagacgcattaatcgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 652 - DNA, 4789 bp, Artificial Sequence
  Synthetic
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggcctctagatcagggtacccgttacataacttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagctgagcaagaggtaagggtttaagggatggttggttggtggggtattaatgtttaattacctggagcacctgcctgaaatcactttttttcaggttggaccggtgccaccatgaaacggacagccgacggaagcgagttcgagtcaccaaagaagaagcggaaagtcgatagcctgctgatgaatcggaggaagtttctgtaccagttcaaaaatgtgcggtgggcaaaagggcgaagggagacctacctgtgctatgtggtgaagaggagagatagcgccaccagcttctccctggactttggctacctgaggaacaagaatggctgccacgtggagctgctgttcctgcggtacatctccgactgggatctggaccccggccggtgttatcgcgtgacctggttcacatcttggagcccttgctacgattgtgccaggcacgtggccgactttctgagaggcaacccaaatctgtctctgcggatcttcaccgcccgcctgtatttttgcgaggatcggaaggccgagccagagggcctgcggcgcctgcacagggccggcgtgcagatcgccatcatgacattcaaggactacttttattgttggaacaccttcgtggagaatcacgagaggaccttcaaggcctgggagggcctgcacgagaactccgtgaggctgagcaggcagctgaggagaatcctgctgcccctgtatgaagtggacgacctgcgggacgcctttagaactctgggactgtctggaggatctagcggaggatcctctggcagcgagacaccaggaacaagcgagtcagcaacaccagagagcagtggcggcagcagcggcggcagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgacgagattttcgagcgggagctggacctgatgagagtggataacctgcctaatagcggaggcagtaaaagaacagcagacgggagtgagtttgagcccaagaaaaagagaaaggtgtaagatctgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttagttcttgccacggcggaactcatcgccgcctgccttgcccgctgctggacaggggctcggctgttgggcactgacaattccgtggtgcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgagaaaaaaagcaccgactcggtgccactttttcaagttgataacggactagccttattttaacttgctatttctagctctaaaaccgagacgcattaatcgtctcgggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 653 - DNA, 4849 bp, Artificial Sequence; identical to SEQ ID NO: 649
  Synthetic

SEQ ID NO: 654 - DNA, 23 bp, Artificial Sequence
  Synthetic
  misc_feature (21)..(21): n is a, c, g, or t
gctaacagccagtaacatcangg

SEQ ID NO: 655 - DNA, 23 bp, Artificial Sequence
  Synthetic
gctaacagccagtaacatcacgg

SEQ ID NO: 656 - DNA, 23 bp, Artificial Sequence
  Synthetic
gctaatagccagtaacatcacgg

SEQ ID NO: 657 - DNA, 23 bp, Artificial Sequence
  Synthetic
gctaaaaaacaataacatcatgg

SEQ ID NO: 658 - DNA, 23 bp, Artificial Sequence
  Synthetic
tcaaatagccagtaaaatcaggg

SEQ ID NO: 659 - DNA, 23 bp, Artificial Sequence
  Synthetic
tctagcagacaataacatcaggg

SEQ ID NO: 660 - DNA, 23 bp, Artificial Sequence
  Synthetic
gctaaaagaaagaaacatcaagg

SEQ ID NO: 661 - DNA, 23 bp, Artificial Sequence
  Synthetic
gataaaagccaaaaacatcatgg

SEQ ID NO: 662 - DNA, 48 bp, Artificial Sequence
  Synthetic
cagtttggttcctcagtggcctcgtgcttcctgttcctcaggtggatg

SEQ ID NO: 663 - protein, 14 aa, Artificial Sequence
  Synthetic
  misc_feature (9)..(9): X may be Y or C
QFGSSVASXFLFLR

SEQ ID NO: 664 - DNA, 48 bp, Artificial Sequence
  Synthetic
catccacctgaggaacaggaagcacgaggccactgaggaaccaaactg

SEQ ID NO: 665 - DNA, 23 bp, Artificial Sequence
  Synthetic
caggaagcacgaggccactgagg

SEQ ID NO: 666 - DNA, 23 bp, Artificial Sequence
  Synthetic
aggaagcacgaggccactgagga

SEQ ID NO: 667 - DNA, 23 bp, Artificial Sequence
  Synthetic
aacaggaagcacgaggccactga

SEQ ID NO: 668 - DNA, 23 bp, Artificial Sequence
  Synthetic
  misc_feature (21)..(21): n is a, c, g, or t
caggaagcacgaggccactgngg

SEQ ID NO: 669 - DNA, 20 bp, Artificial Sequence
  Synthetic
ctccgcgagtaccctgagca

SEQ ID NO: 670 - DNA, 20 bp, Artificial Sequence
  Synthetic
ctccatgagtaccctgagca

SEQ ID NO: 671 - DNA, 21 bp, Artificial Sequence
  Synthetic
gccccttccgcgcgctccacg

SEQ ID NO: 672 - DNA, 20 bp, Artificial Sequence
  Synthetic
ttctacagccacataaccag

SEQ ID NO: 673 - DNA, 20 bp, Artificial Sequence
  Synthetic
gtgatggagagtcctcatac

SEQ ID NO: 674 - DNA, 20 bp, Artificial Sequence
  Synthetic
caggtcgaccaaggatacag

SEQ ID NO: 675 - DNA, 20 bp, Artificial Sequence
  Synthetic
cactgtatccttggtcaacc

SEQ ID NO: 676 - DNA, 20 bp, Artificial Sequence
  Synthetic
ttacgtggctctggggcatc

SEQ ID NO: 677 - DNA, 20 bp, Artificial Sequence
  Synthetic
gacaacactatcttcaacct

SEQ ID NO: 678 - DNA, 20 bp, Artificial Sequence
  Synthetic
tgtcctctacgaacagtacc

SEQ ID NO: 679 - DNA, 20 bp, Artificial Sequence
  Synthetic
cacaccggaggggagagggg

SEQ ID NO: 680 - DNA, 20 bp, Artificial Sequence
  Synthetic
tcgataggcactgccgttaa

SEQ ID NO: 681 - DNA, 20 bp, Artificial Sequence
  Synthetic
cttacagccagtaatgtcac

SEQ ID NO: 682 - DNA, 20 bp, Artificial Sequence
  Synthetic
aagtcaggctttcttcagag

SEQ ID NO: 683 - DNA, 20 bp, Artificial Sequence
  Synthetic
ttgacactctgaagaaagcc

SEQ ID NO: 684 - DNA, 20 bp, Artificial Sequence
  Synthetic
gcgtggtaggtcatgaagta

SEQ ID NO: 685 - DNA, 20 bp, Artificial Sequence
  Synthetic
gtacgtgactccgaccctgg

SEQ ID NO: 686 - DNA, 20 bp, Artificial Sequence
  Synthetic
actacaggcagcatgtcccc

SEQ ID NO: 687 - DNA, 20 bp, Artificial Sequence
  Synthetic
tcaagggacatgctgcctat

SEQ ID NO: 688 - DNA, 20 bp, Artificial Sequence
  Synthetic
ctcagaggggagacttcatg

SEQ ID NO: 689 - DNA, 20 bp, Artificial Sequence
  Synthetic
cagcaaacgcaggcagggtc

SEQ ID NO: 690 - DNA, 20 bp, Artificial Sequence
  Synthetic
aactagtcagtgatattgtc

SEQ ID NO: 691 - DNA, 20 bp, Artificial Sequence
  Synthetic
tgtcaagtggacaatatcac

SEQ ID NO: 692 - DNA, 20 bp, Artificial Sequence
  Synthetic
actcaacagcaagacgactg

SEQ ID NO: 693 - DNA, 20 bp, Artificial Sequence
  Synthetic
gcaagacaactgtggcttca

SEQ ID NO: 694 - DNA, 20 bp, Artificial Sequence
  Synthetic
ggatgaagccacagtcgtct

SEQ ID NO: 695 - DNA, 20 bp, Artificial Sequence
  Synthetic
tttcaactgggtgaagccac

SEQ ID NO: 696 - DNA, 20 bp, Artificial Sequence
  Synthetic
gatcaacgattatttcgact

SEQ ID NO: 697 - DNA, 20 bp, Artificial Sequence
  Synthetic
acaagggggcgaagcctatt

SEQ ID NO: 698 - DNA, 20 bp, Artificial Sequence
  Synthetic
ccaaataggcttcgccccct

SEQ ID NO: 699 - DNA, 20 bp, Artificial Sequence
  Synthetic
gcaccgcgttaaatatctgc

SEQ ID NO: 700 - DNA, 20 bp, Artificial Sequence
  Synthetic
ctactgcaccagggaatcat

SEQ ID NO: 701 - DNA, 20 bp, Artificial Sequence
  Synthetic
ctacaccagggaatcattgt

SEQ ID NO: 702 - DNA, 20 bp, Artificial Sequence
  Synthetic
tgtgcagcggcatgggctgc

SEQ ID NO: 703 - DNA, 20 bp, Artificial Sequence
  Synthetic
gttctaccccttggaagaag

SEQ ID NO: 704 - DNA, 20 bp, Artificial Sequence
  Synthetic
gcctatgtactttgtcctgg

SEQ ID NO: 705 - DNA, 20 bp, Artificial Sequence
  Synthetic
gcagacccgcatgcaggtac

SEQ ID NO: 706 - DNA, 20 bp, Artificial Sequence
  Synthetic
gcatcaaaagagactgatcc

SEQ ID NO: 707 - DNA, 20 bp, Artificial Sequence
  Synthetic
agaacaggagtttttgaaga

SEQ ID NO: 708 - DNA, 20 bp, Artificial Sequence
  Synthetic
ttaaacatcaagaggtaagt

SEQ ID NO: 709 - DNA, 20 bp, Artificial Sequence
  Synthetic
atacctagtaggcctgcacc

SEQ ID NO: 710 - DNA, 20 bp, Artificial Sequence
  Synthetic
caggatgacttcaatcacaa

SEQ ID NO: 711 - DNA, 20 bp, Artificial Sequence
  Synthetic
cactgtgattgaagtcatcc

SEQ ID NO: 712 - DNA, 20 bp, Artificial Sequence
  Synthetic
gaaggtcaagggcaacccaa

SEQ ID NO: 713 - DNA, 20 bp, Artificial Sequence
  Synthetic
tcatgctgagctcggtggct

SEQ ID NO: 714 - DNA, 20 bp, Artificial Sequence
  Synthetic
tcaagtggattcgaaggtct

SEQ ID NO: 715 - DNA, 20 bp, Artificial Sequence
  Synthetic
tctgataagccggggggggg

SEQ ID NO: 716 - DNA, 20 bp, Artificial Sequence
  Synthetic
ccttgaggcacatgaaaagc

SEQ ID NO: 717 - DNA, 20 bp, Artificial Sequence
  Synthetic
tcaccttcaatacttcgttc

SEQ ID NO: 718 - DNA, 20 bp, Artificial Sequence
  Synthetic
tcattcagcagtgaaggaaa

SEQ ID NO: 719 - DNA, 20 bp, Artificial Sequence
  Synthetic
cacaggaacactggtccacc

SEQ ID NO: 720 - DNA, 20 bp, Artificial Sequence
  Synthetic
acaggtgggtcatatgcaga

SEQ ID NO: 721 - DNA, 20 bp, Artificial Sequence
  Synthetic
tacagtaagtggcaagagac

SEQ ID NO: 722 - DNA, 20 bp, Artificial Sequence
  Synthetic
accatacgcagtacagaaag

SEQ ID NO: 723 - DNA, 20 bp, Artificial Sequence
  Synthetic
actacgtacggtaagtggca

SEQ ID NO: 724 - DNA, 20 bp, Artificial Sequence
  Synthetic
atacagtgaaagaggggcca

SEQ ID NO: 725 - DNA, 20 bp, Artificial Sequence
  Synthetic
ttataagtcaagaacctgaa

SEQ ID NO: 726 - DNA, 20 bp, Artificial Sequence
  Synthetic
caagttcttgacttacaaat

SEQ ID NO: 727 - DNA, 20 bp, Artificial Sequence
  Synthetic
tgatatggagagtgtggaat

SEQ ID NO: 728 - DNA, 20 bp, Artificial Sequence
  Synthetic
ctatatgtcaagcggaggtc

SEQ ID NO: 729 - DNA, 20 bp, Artificial Sequence
  Synthetic
ggaagtccaaagggtacatc

SEQ ID NO: 730 - DNA, 20 bp, Artificial Sequence
  Synthetic
agctactccgtccggaagaa

SEQ ID NO: 731 - DNA, 20 bp, Artificial Sequence
  Synthetic
ttccagacggagcagctcat

SEQ ID NO: 732 - DNA, 20 bp, Artificial Sequence
  Synthetic
cagcataaccgctcgcggcc

SEQ ID NO: 733 - DNA, 20 bp, Artificial Sequence
  Synthetic
caggcaagcctggctgctgg

SEQ ID NO: 734 - DNA, 20 bp, Artificial Sequence
  Synthetic
ctagtcagcccccagcagcc

SEQ ID NO: 735 - DNA, 20 bp, Artificial Sequence
  Synthetic
aatccagctgacctctggtc

SEQ ID NO: 736 - DNA, 20 bp, Artificial Sequence
  Synthetic
ccaagagaggcgtcctgctg

SEQ ID NO: 737 - DNA, 20 bp, Artificial Sequence
  Synthetic
ggtcacgctgtggccgcgca

SEQ ID NO: 738 - DNA, 20 bp, Artificial Sequence
  Synthetic
tcttagcagctacatggtgc

SEQ ID NO: 739 - DNA, 20 bp, Artificial Sequence
  Synthetic
aggcaggtataaagattcca

SEQ ID NO: 740 - DNA, 20 bp, Artificial Sequence
  Synthetic
ctgtatgggaaggacgctga

SEQ ID NO: 741 - DNA, 20 bp, Artificial Sequence
  Synthetic
tattataactctttcacatt

SEQ ID NO: 742 - DNA, 20 bp, Artificial Sequence
  Synthetic
tctgtcaagggctacatgtc

SEQ ID NO: 743 - DNA, 20 bp, Artificial Sequence
  Synthetic
tgacacgtagccctcgacag

What is claimed is:

1. A nucleic acid molecule comprising:

a first nucleic acid segment encoding a N-terminal portion of a nucleobase editor fused at its C-terminus to a first intein sequence, wherein the first nucleic acid segment is operably linked to a first promoter; and a second nucleic acid segment encoding a guide RNA (gRNA) operably linked to a second promoter, wherein the direction of transcription of the second nucleic acid segment is reversed relative to the direction of transcription of the first nucleic acid segment; and wherein the nucleic acid molecule comprises a sequence that is at least 90% identical to a sequence selected from the group consisting of SEQ ID NOs: 642, 644, 646, 648, 650, and 652.

2. The nucleic acid molecule of claim 1, wherein the first intein sequence comprises the amino acid sequence as set forth in SEQ ID NO: 351.

3. The nucleic acid molecule of claim 1 further comprising a transcriptional terminator.

99% identical to a sequence selected from the group consisting of SEQ ID NOs: 642, 644, 646, 648, 650, and 652.

14. A recombinant AAV (rAAV) particle comprising the nucleic acid molecule of claim 1.

15. The rAAV particle of claim 14, wherein the rAAV particle is an rAAV2 particle, rAAV6 particle, rAAV8 particle, rPHP.B particle, rPHP.eB particle, or rAAV9 particle.

16. The rAAV particle of claim 14, wherein the rAAV particle is an rAAV9 particle.

17. A cell in vitro comprising the rAAV particle of claim 14.

18. The cell of claim 17, wherein the cell is a human cell.

19. A method comprising:

administering to a subject in need thereof a therapeutically effective amount of the rAAV particle of claim 14, wherein the subject has a disease or disorder, and wherein the disease or disorder is Niemann-Pick type C (NPC) disease.

20. The cell of claim 18, wherein the human cell is a retinal cell, a cortical cell, or a cerebellar cell.

* * * * *